(12) United States Patent
Kufer et al.

(10) Patent No.: US 9,150,664 B2
(45) Date of Patent: Oct. 6, 2015

(54) BINDING MOLECULES FOR BCMA AND CD3

(71) Applicants: Amgen Research (Munich) GmbH, Munich (DE); Boehringer Ingelheim International GmbH, Ingelheim am Rhein (DE)

(72) Inventors: Peter Kufer, Munich (DE); Tobias Raum, Munich (DE); Patrick Hoffmann, Munich (DE); Roman Kischel, Munich (DE); Ralf Lutterbuese, Munich (DE); Doris Rau, Munich (DE); Paul Adam, Ingelheim am Rhein (DE); Eric Borges, Ingelheim am Rhein (DE); Barbara Hebeis, Ingelheim am Rhein (DE); Susanne Hipp, Ingelheim am Rhein (DE)

(73) Assignees: AMGEN RESEARCH (MUNICH) GMBH, Munich (DE); BOEHRINGER INGELHEIM INTERNATIONAL GMBH, Ingelheim am Rhein (DE)

( * ) Notice: Subject to any disclaimer, the term of this patent is extended or adjusted under 35 U.S.C. 154(b) by 0 days.

(21) Appl. No.: 13/678,264

(22) Filed: Nov. 15, 2012

(65) Prior Publication Data
US 2013/0156770 A1    Jun. 20, 2013

Related U.S. Application Data

(60) Provisional application No. 61/651,486, filed on May 24, 2012, provisional application No. 61/651,474, filed on May 24, 2012, provisional application No. 61/560,144, filed on Nov. 15, 2011, provisional application No. 61/560,149, filed on Nov. 15, 2011, provisional application No. 61/560,162, filed on Nov. 15, 2011, provisional application No. 61/560,178, filed on Nov. 15, 2011, provisional application No. 61/560,183, filed on Nov. 15, 2011.

(51) Int. Cl.
*C07K 16/28* (2006.01)
*C07K 16/46* (2006.01)
*C07K 14/575* (2006.01)
*A61K 39/395* (2006.01)
*C07K 14/705* (2006.01)
*A61K 39/00* (2006.01)

(52) U.S. Cl.
CPC ........... *C07K 16/468* (2013.01); *A61K 39/0005* (2013.01); *C07K 14/70578* (2013.01); *C07K 16/2809* (2013.01); *C07K 16/2875* (2013.01); *C07K 16/2878* (2013.01); *A61K 2039/505* (2013.01); *A61K 2039/575* (2013.01); *C07K 2317/31* (2013.01); *C07K 2317/33* (2013.01); *C07K 2317/34* (2013.01); *C07K 2317/56* (2013.01); *C07K 2317/565* (2013.01); *C07K 2317/622* (2013.01); *C07K 2317/73* (2013.01); *C07K 2317/92* (2013.01); *C07K 2317/94* (2013.01); *C07K 2319/00* (2013.01); *C07K 2319/21* (2013.01); *C07K 2319/30* (2013.01); *C07K 2319/31* (2013.01); *C07K 2319/43* (2013.01)

(58) Field of Classification Search
CPC ............ C07K 16/468; C07K 16/2878; C07K 16/2809; C07K 14/70758; C07K 2317/31; C07K 2317/33; C07K 2317/56; C07K 2317/565; C07K 2317/622; C07K 2317/92; C07K 2317/94; A61K 2039/505
See application file for complete search history.

(56) References Cited

U.S. PATENT DOCUMENTS 8,105,603 B2 *   1/2012  Kelley et al. ............... 424/185.1
2013/0156769 A1  6/2013  Kufer et al.

FOREIGN PATENT DOCUMENTS

| WO | WO 01/87977     | 11/2001   |
|----|-----------------|-----------|
| WO | WO 02/066516    | 8/2002    |
| WO | WO 2004/106383  | 12/2004   |
| WO | WO 2008/119567  | * 10/2008 |
| WO | WO 2009/132058  | 10/2009   |
| WO | WO 2010/104949  | 9/2010    |
| WO | WO 2012/066058  | 5/2012    |

OTHER PUBLICATIONS

Vajdos et al., J Mol Biol. 320(2):415-28, Jul. 5, 2002.*
NP_001183 from WWW.ncbi.nlm.nih.gov/protein/NP_001183, 3 pages, printed Oct. 31, 2014.*
Ryan, M.C., et al., (2007) *Antibody targeting of B-cell maturation antigen on malignant plasma cells*. Mol Cancer Ther, 6: 3009-3018.
Colman, P.M., (1994) *Effects of amino acid sequence changes on antibody-antigen interactions*, Research in Immunology, 145: 33-36.
MacCallum, R.M., et aL, (1996) *Antibody-antigen Interactions: Contact Analysis and Binding Site Topography*, J. Mol. Biol., 262: 732-745.
Rudikoff, S., et al., (1982) *Single amino acid substitution altering antigen-binding specificity*, Proc. Natl. Acad. Sci. USA, 79: 1979-1983.
Wu, H., et al., (1999) *Humanization of a Murine Monoclonal Antibody by Simultaneous Optimization of Framework and CDR Residues*, J. Mol. Biol., 294: 151-162.
Yu, L., et al., (2008) *Interaction between Bevacizumab and Murine VEGF-A: A Reassessment*, Investigative Ophthalmology & Visual Science, 49: 522-527.

* cited by examiner

*Primary Examiner* — Phuong Huynh
(74) *Attorney, Agent, or Firm* — Kagan Binder, PLLC

(57) ABSTRACT

The present invention relates to a binding molecule comprising a first and a second binding domain, wherein the first binding domain is capable of binding to epitope clusters of BCMA, and the second binding domain is capable of binding to the T cell CD3 receptor complex. Moreover, the invention provides a nucleic acid sequence encoding the binding molecule, a vector comprising said nucleic acid sequence and a host cell transformed or transfected with said vector. Furthermore, the invention provides a process for the production of the binding molecule of the invention, a medical use of said binding molecule and a kit comprising said binding molecule.

15 Claims, 26 Drawing Sheets

Figure 1:
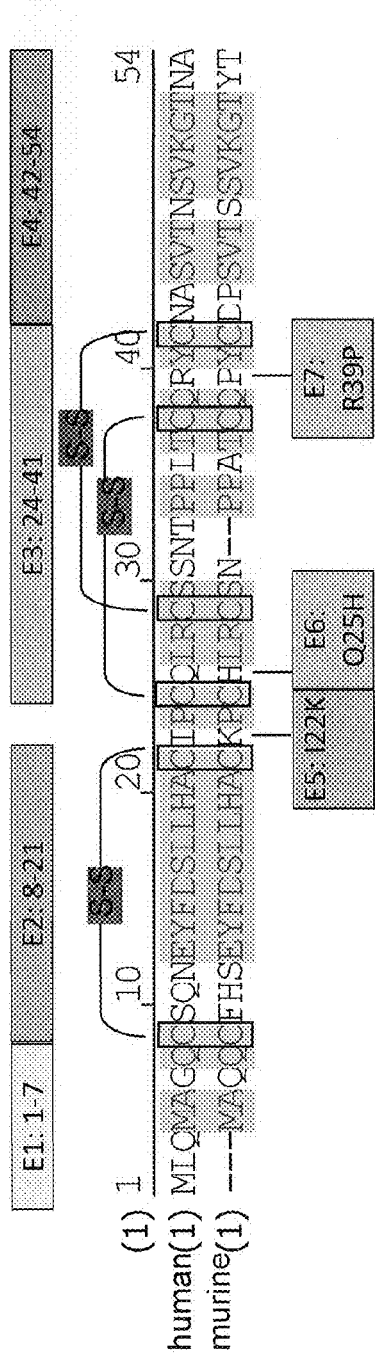

E1: N-terminal domain
E2: First disulfide bound defined domain
E3: Second (double) disulfide bound defined domain
E4: C-terminal extracellular domain
E5: Inter-E2/E3 point mutation
E6+E7: E3 point mutations Hu BCMA-CHO**

Mu BCMA-CHO*

\* Extracellular BCMA fused to transmembrane plus cytoplasmatic human EpCAM

\*\* unmodified transmembrane BCMA hu BCMA E1 mu-CHO*, hu BCMA E2 mu-CHO*, hu BCMA E3 mu-CHO*, hu BCMA E4 mu-CHO**, hu BCMA E5 mu-CHO*, hu BCMA E6 mu-CHO*, hu BCMA E7 mu-CHO*

Domain exchanges | Single amino acid exchanges

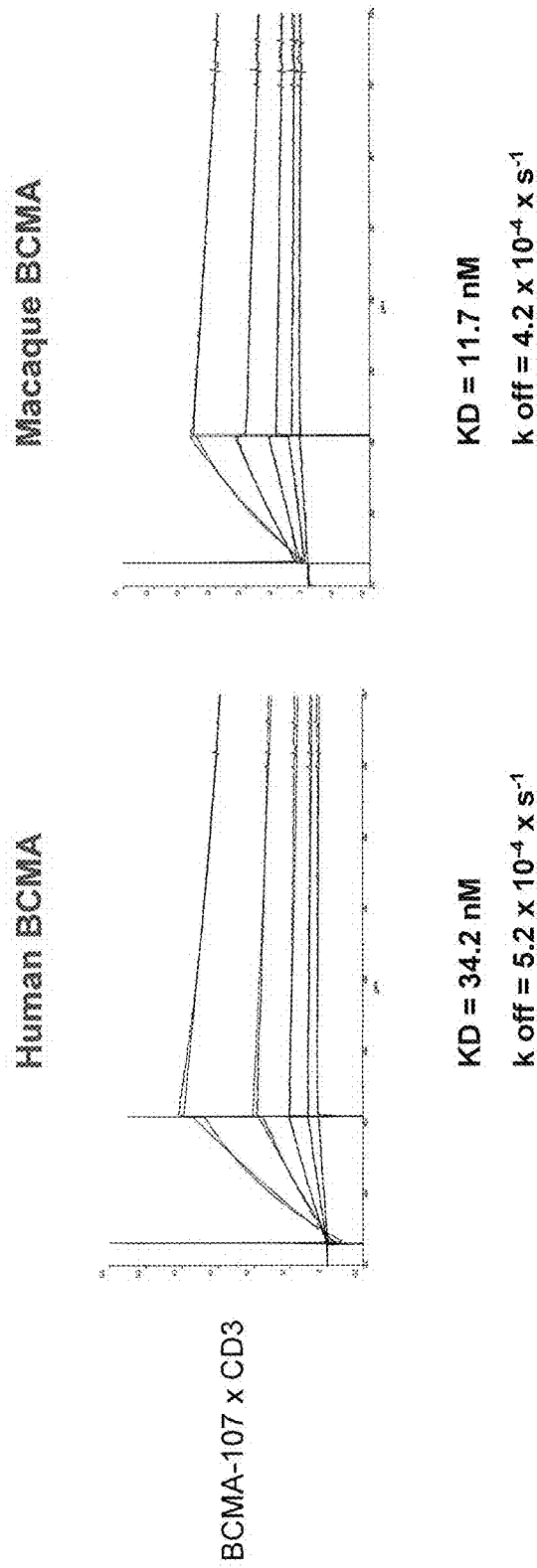

BINDING MOLECULES FOR BCMA AND CD3

This application claims the benefit of U.S. Provisional Patent Application Ser. No. 61/651,486 filed May 24, 2012, entitled BINDING MOLECULES FOR BCMA AND CD3 (E3); U.S. Provisional Patent Application Ser. No. 61/651,474 filed May 24, 2012, entitled BINDING MOLECULES FOR BCMA AND CD3 (E3-E4); U.S. Provisional Patent Application Ser. No. 61/560,144 filed Nov. 15, 2011, entitled BINDING MOLECULES FOR BCMA AND CD3 (E3); U.S. Provisional Patent Application Ser. No. 61/560,149 filed Nov. 15, 2011, entitled BINDING MOLECULES FOR BCMA AND CD3 (E1-E4); U.S. Provisional Patent Application Ser. No. 61/560,162 filed Nov. 15, 2011, entitled BINDING MOLECULES FOR BCMA AND CD3 (E3-E4); U.S. Provisional Patent Application Ser. No. 61/560,178 filed Nov. 15, 2011, entitled BINDING MOLECULES FOR BCMA AND CD3 (CROSS); and U.S. Provisional Patent Application Ser. No. 61/560,183 filed Nov. 15, 2011, entitled BINDING MOLECULES FOR BCMA AND CD3 (E1-E7); the disclosures of which are incorporated herein by reference. Also, the entire contents of the ASCII text file entitled "IPM0030US_sequence_listing_091213_ST25.txt" created on Dec. 13, 2013, having a size of 1024 kilobytes is incorporated herein by reference.

BACKGROUND

BCMA (B-cell maturation antigen, TNFRSF17, CD269) is a transmembrane protein belonging to the TNF receptor super family. BCMA is originally reported as an integral membrane protein in the Golgi apparatus of human mature B lymphocytes, i.e., as an intracellular protein (Gras et al., (1995) International Immunol 7(7):1093-1105) showing that BCMA seems to have an important role during B-cell development and homeostasis. The finding of Gras et al. might be associated with the fact that the BCMA protein that was described in Gras et al. is, because of a chromosomal translocation, a fusion protein between BCMA and IL-2. Meanwhile BCMA is, however, established to be a B-cell marker that is essential for B-cell development and homeostasis (Schliemann et al., (2001) Science 293 (5537):2111-2114) due to its presumably essential interaction with its ligands BAFF (B cell activating factor), also designated as TALL-1 or TNFSF13B, and APRIL (A proliferation-inducing ligand).

BCMA expression is restricted to the B-cell lineage and mainly present on plasma cells and plasmablasts and to some extent on memory B-cells, but virtually absent on peripheral and naive B-cells. BCMA is also expressed on multiple myeloma (MM) cells. Together with its family members transmembrane activator and cyclophylin ligand interactor (TACI) and B cell activation factor of TNF family receptor (BAFF-R), BCMA regulates different aspects of humoral immunity, B-cell development and homeostasis. Expression of BCMA appears rather late in B-cell differentiation and contributes to the long term survival of plasmablasts and plasma cells in the bone marrow. Targeted deletion of the BCMA gene in mice does not affect the generation of mature B-cells, the quality and magnitude of humoral immune responses, formation of germinal center and the generation of short-lived plasma cells. However, such mice have significantly reduced numbers of long-lived plasma cells in the bone marrow, indicating the importance of BCMA for their survival (O'Connor et al., 2004).

In line with this finding, BCMA also supports growth and survival of multiple myeloma(MM) cells. Novak et al found that MM cell lines and freshly isolated MM cells express BCMA and TACI protein on their cell surfaces and have variable expression of BAFF-R protein on their cell surface (Novak et al., (2004) Blood 103(2):689-694).

Multiple myeloma (MM) is the second most common hematological malignancy and constitutes 2% of all cancer deaths. MM is a heterogenous disease and caused by mostly by chromosome translocations inter aliat (11;14),t(4;14),t(8;14),del(13),del(17) (Drach et al., (1998) Blood 92(3):802-809; Gertz et al., (2005) Blood 106(8):2837-2840; Facon et al., (2001) Blood 97(6):1566-1571). MM-affected patients may experience a variety of disease-related symptoms due to, bone marrow infiltration, bone destruction, renal failure, immunodeficiency, and the psychosocial burden of a cancer diagnosis. As of 2006, the 5-year relative survival rate for MM was approximately 34% highlighting that MM is a difficult-to-treat disease where there are currently no curative options.

Exciting new therapies such as chemotherapy and stem cell transplantation approaches are becoming available and have improved survival rates but often bring unwanted side effects, and thus MM remains still incurable (Lee et al., (2004) J Natl Compr Canc Netw 8 (4): 379-383). To date, the two most frequently used treatment options for patients with multiple myeloma are combinations of steroids, thalidomide, lenalidomide, bortezomib or various cytotoxic agents, and for younger patients high dose chemotherapy concepts with autologous stem cell transplantation. Most transplants are of the autologous type, i.e. using the patient's own cells. Such transplants, although not curative, have been shown to prolong life in selected patients. They can be performed as initial therapy in newly diagnosed patients or at the time of relapse. Sometimes, in selected patients, more than one transplant may be recommended to adequately control the disease.

Chemotherapeutic agents used for treating the disease are Cyclophosphamid, Doxorubicin, Vincristin and Melphalan, combination therapies with immunomodulating agents such as thalidomide (Thalomid®), lenalidomide (Revlimid®), bortezomib (Velcade®) and corticosteroids (e.g. Dexamethasone) have emerged as important options for the treatment of myeloma, both in newly diagnosed patients and in patients with advanced disease in whom chemotherapy or transplantation have failed.

The currently used therapies are usually not curative. Stem cell transplantation may not be an option for many patients because of advanced age, presence of other serious illness, or other physical limitations. Chemotherapy only partially controls multiple myeloma, it rarely leads to complete remission. Thus, there is an urgent need for new, innovative treatments.

Bellucci et al. (Blood, 2005; 105(10) identified BCMA-specific antibodies in multiple myeloma patients after they had received donor lymphocyte infusions (DLI). Serum of these patients was capable of mediating BCMA-specific cell lysis by ADCC and CDC and was solely detected in patients with anti-tumor responses (4/9), but not in non-responding patients (0/6). The authors speculate that induction of BCMA-specific antibodies contributes to elimination of myeloma cells and long-term remission of patients.

Ryan et al. (Mol. Cancer. Ther. 2007; 6(11) reported the generation of an antagonistic BCMA-specific antibody that prevents NF-κB activation which is associated with a potent pro-survival signaling pathway in normal and malignant B-cells. In addition, the antibody conferred potent antibody-dependent cell-mediated cytotoxicity (ADCC) to multiple myeloma cell lines in vitro which was significantly enhanced by Fc-engineering.

Other approaches in fighting blood-borne tumors or autoimmune disorders focus on the interaction between BAFF and APRIL, i.e., ligands of the TNF ligand super family, and their receptors TACI, BAFF-R and BCMA which are activated by BAFF and/or APRIL. For example, by fusing the Fc-domain of human immunoglobulin to TACI, Zymogenetics, Inc. has generated Atacicept (TACI-Ig) to neutralize both these ligands and prevent receptor activation. Atacicept is currently in clinical trials for the treatment of Systemic Lupus Erythematosus (SLE, phase III), multiple sclerosis (MS, phase II) and rheumatoid arthritis (RA, phase II), as well as in phase I clinical trials for the treatment of the B-cell malignancies chronic lymphocytic leukaemia (CLL), non-Hodgkins lymphoma (NHL) and MM. In preclinical studies atacicept reduces growth and survival of primary MM cells and MM cell lines in vitro (Moreaux et al, Blood, 2004, 103) and in vivo (Yaccoby et al, Leukemia, 2008, 22, 406-13), demonstrating the relevance of TACI ligands for MM cells. Since most MM cells and derived cell lines express BCMA and TACI, both receptors might contribute to ligand-mediated growth and survival. These data suggest that antagonizing both BCMA and TACI might be beneficial in the treatment of plasma cell disorders. In addition, BCMA-specific antibodies that cross react with TACI have been described (WO 02/066516).

Human Genome Sciences and GlaxoSmithKline have developed an antibody targeting BAFF which is called Belimumab. Belimumab blocks the binding of soluble BAFF to its receptors BAFF-R, BCMA and TACI on B cells. Belimumab does not bind B cells directly, but by binding BAFF, belimumab inhibits the survival of B cells, including autoreactive B cells, and reduces the differentiation of B cells into immunoglobulin-producing plasma cells.

Nevertheless, despite the fact that BCMA; BAFF-R and TACI, i.e., B cell receptors belonging to the TNF receptor super family, and their ligands BAFF and APRIL are subject to therapies in fighting against cancer and/or autoimmune disorders, there is still a need for having available further options for the treatment of such medical conditions.

Accordingly, there is provided herewith means and methods for the solution of this problem in the form of a binding molecule which is at least bispecific with one binding domain to cytotoxic cells, i.e., cytotoxic T cells, and with a second binding domain to BCMA.

It must be noted that as used herein, the singular forms "a", "an", and "the", include plural references unless the context clearly indicates otherwise. Thus, for example, reference to "a reagent" includes one or more of such different reagents and reference to "the method" includes reference to equivalent steps and methods known to those of ordinary skill in the art that could be modified or substituted for the methods described herein.

Unless otherwise indicated, the term "at least" preceding a series of elements is to be understood to refer to every element in the series. Those skilled in the art will recognize, or be able to ascertain using no more than routine experimentation, many equivalents to the specific embodiments of the invention described herein. Such equivalents are intended to be encompassed by the present invention.

The term "and/or" wherever used herein includes the meaning of "and", "or" and "all or any other combination of the elements connected by said term".

The term "about" or "approximately" as used herein means within ±20%, preferably within ±15%, more preferably within ±10%, and most preferably within ±5% of a given value or range.

Throughout this specification and the claims which follow, unless the context requires otherwise, the word "comprise", and variations such as "comprises" and "comprising", will be understood to imply the inclusion of a stated integer or step or group of integers or steps but not the exclusion of any other integer or step or group of integer or step. When used herein the term "comprising" can be substituted with the term "containing" or "including" or sometimes when used herein with the term "having".

When used herein "consisting of" excludes any element, step, or ingredient not specified in the claim element. When used herein, "consisting essentially of" does not exclude materials or steps that do not materially affect the basic and novel characteristics of the claim.

In each instance herein any of the terms "comprising", "consisting essentially of" and "consisting of" may be replaced with either of the other two terms.

General Description

Epitope clusters 1, 2, 3, 4, 5, 6, 7 are comprised by the extracellular domain of BCMA. The "BCMA extracellular domain" or "BCMA ECD" refers to a form of BCMA which is essentially free of transmembrane and cytoplasmic domains of BCMA. It will be understood by the skilled artisan that the transmembrane domain identified for the BCMA polypeptide of the present invention is identified pursuant to criteria routinely employed in the art for identifying that type of hydrophobic domain. The exact boundaries of a transmembrane domain may vary but most likely by no more than about 5 amino acids at either end of the domain specifically mentioned herein. A preferred BCMA ECD is shown in SEQ ID NO: 1007. A preferred murine ECD is shown in SEQ ID NO: 1008.

Epitope cluster 1 corresponds to amino acids 1 to 7 of the human BCMA extracellular domain (SEQ ID NO:1007), epitope cluster 2 corresponds to amino acids 8 to 21 of the human BCMA extracellular domain (SEQ ID NO:1007), epitope cluster 3 corresponds to amino acids 24 to 41 of the human BCMA extracellular domain (SEQ ID NO:1007), epitope cluster 4 corresponds to amino acids 42 to 54 of the human BCMA extracellular domain (SEQ ID NO:1007), epitope cluster 5 corresponds to amino acid 22 of the human BCMA extracellular domain (SEQ ID NO:1007), epitope cluster 6 corresponds to amino acid 25 of the human BCMA extracellular domain (SEQ ID NO:1007), and epitope cluster 7 corresponds to amino acid 39 of the human BCMA extracellular domain (SEQ ID NO:1007). It is envisaged that epitope clusters 5 to 7 represent single amino acid substitutions.

The T cell CD3 receptor complex is a protein complex and is composed of four distinct chains. In mammals, the complex contains a CD3γ chain, a CD3δ chain, and two CD3ε (epsilon) chains. These chains associate with a molecule known as the T cell receptor (TCR) and the ζ chain to generate an activation signal in T lymphocytes.

The redirected lysis of target cells via the recruitment of T cells by bispecific molecules involves cytolytic synapse formation and delivery of perforin and granzymes. The engaged T cells are capable of serial target cell lysis, and are not affected by immune escape mechanisms interfering with peptide antigen processing and presentation, or clonal T cell differentiation; see, for example, WO 2007/042261.

The term "binding molecule" in the sense of the present disclosure indicates any molecule capable of (specifically) binding to, interacting with or recognizing the target molecules BCMA and CD3. According to the present invention, binding molecules are preferably polypeptides. Such polypeptides may include proteinaceous parts and non-proteinaceous parts (e.g. chemical linkers or chemical cross-linking agents such as glutaraldehyde).

A binding molecule, so to say, provides the scaffold for said one or more binding domains so that said binding domains can bind/interact with the target molecules BCMA and CD3. For example, such a scaffold could be provided by protein A, in particular, the Z-domain thereof (affibodies), ImmE7 (immunity proteins), BPTI/APPI (Kunitz domains), Ras-binding protein AF-6 (PDZ-domains), charybdotoxin (Scorpion toxin), CTLA-4, Min-23 (knottins), lipocalins (anticalins), neokarzinostatin, a fibronectin domain, an ankyrin consensus repeat domain or thioredoxin (Skerra, Curr. Opin. Biotechnol. 18, 295-304 (2005); Hosse et al., Protein Sci. 15, 14-27 (2006); Nicaise et al., Protein Sci. 13, 1882-1891 (2004); Nygren and Uhlen, Curr. Opin. Struc. Biol. 7, 463-469 (1997)). A preferred binding molecule is an antibody.

It is also envisaged that the binding molecule of the invention has, in addition to its function to bind to the target molecules BCMA and CD3, a further function. In this format, the binding molecule is a tri- or multifunctional binding molecule by targeting plasma cells through binding to BCMA, mediating cytotoxic T cell activity through CD3 binding and providing a further function such as a fully functional Fc constant domain mediating antibody-dependent cellular cytotoxicity through recruitment of effector cells like NK cells, a label (fluorescent etc.), a therapeutic agent such as, e.g. a toxin or radionuclide, and/or means to enhance serum half-life, etc.

The term "bispecific" as used herein refers to a binding molecule which comprises at least a first and a second binding domain, wherein the first binding domain is capable of binding to one antigen or target, and the second binding domain is capable of binding to another antigen or target. The "binding molecule" of the invention also comprises multispecific binding molecules such as e.g. trispecific binding molecules, the latter ones including three binding domains.

It is envisaged that the binding molecule is produced by (or obtainable by) phage-display or library screening methods rather than by grafting CDR sequences from a pre-existing (monoclonal) antibody into a scaffold, for example, a scaffold as disclosed herein.

The term "binding domain" characterizes in connection with the present invention a domain which is capable of specifically binding to/interacting with a given target epitope or a given target siteon the target molecules BCMA and CD3.

Binding domains can be derived from a binding domain donor such as for example an antibody, protein A, ImmE7 (immunity proteins), BPTI/APPI (Kunitz domains), Ras-binding protein AF-6 (PDZ-domains), charybdotoxin (Scorpion toxin), CTLA-4, Min-23 (knottins), lipocalins (anticalins), neokarzinostatin, a fibronectin domain, an ankyrin consensus repeat domain or thioredoxin (Skerra, Curr. Opin. Biotechnol. 18, 295-304 (2005); Hosse et al., Protein Sci. 15, 14-27 (2006); Nicaise et al., Protein Sci. 13, 1882-1891 (2004); Nygren and Uhlen, Curr. Opin. Struc. Biol. 7, 463-469 (1997)). A preferred binding domain is derived from an antibody. It is envisaged that a binding domain of the present invention comprises at least said part of any of the aforementioned binding domains that is required for binding to/interacting with a given target epitope or a given target siteon the target molecules BCMA and CD3.

It is envisaged that the binding domain of the aforementioned binding domain donors is characterized by that part of these donors that is responsible for binding the respective target, i.e. when that part is removed from the binding domain donor, said donor loses its binding capability. "Loses" means a reduction of at least 50% of the binding capability when compared with the binding donor. Methods to map these binding sites are well known in the art—it is therefore within the standard knowledge of the skilled person to locate/map the binding site of a binding domain donor and, thereby, to "derive" said binding domain from the respective binding domain donors.

The term "epitope" refers to a site on an antigen to which a binding domain, such as an antibody or immunoglobulin or derivative or fragment of an antibody or of an immunoglobulin, specifically binds. An "epitope" is antigenic and thus the term epitope is sometimes also referred to herein as "antigenic structure" or "antigenic determinant". Thus, the binding domain is an "antigen-interaction-site". Said binding/interaction is also understood to define a "specific recognition". In one example, said binding domain which (specifically) binds to/interacts with a given target epitope or a given target siteon the target molecules BCMA and CD3 is an antibody or immunoglobulin, and said binding domain is a VH and/or VL region of an antibody or of an immunoglobulin. "Epitopes" can be formed both by contiguous amino acids or non-contiguous amino acids juxtaposed by tertiary folding of a protein.

A "linear epitope" is an epitope where an amino acid primary sequence comprises the recognizedepitope. A linear epitope typically includes at least 3 or at least 4, and more usually, at least 5 or at least 6 or at least 7, for example, about 8 to about 10 amino acids in a unique sequence.

A "conformational epitope", in contrast to a linear epitope, is an epitope wherein the primary sequence of the amino acids comprising the epitope is not the sole defining component of the epitope recognized (e.g., an epitope wherein the primary sequence of amino acids is not necessarily recognized by the binding domain). Typically a conformational epitope comprises an increased number of amino acids relative to a linear epitope. With regard to recognition of conformational epitopes, the binding domain recognizes a three-dimensional structure of the antigen, preferably a peptide or protein or fragment thereof (in the context of the present invention, the antigen for one of the binding domains is comprised within the BCMA protein). For example, when a protein molecule folds to form a three-dimensional structure, certain amino acids and/or the polypeptide backbone forming the conformational epitope become juxtaposed enabling the antibody to recognize the epitope. Methods of determining the conformation of epitopes include, but are not limited to, x-ray crystallography, two-dimensional nuclear magnetic resonance (2D-NMR) spectroscopy and site-directed spin labelling and electron paramagnetic resonance (EPR) spectroscopy. Moreover, the provided examples describe a further method to test whether a given binding domain binds to one or more epitope cluster(s) of a given protein, in particular BCMA.

As used herein, the term "epitope cluster" denotes the entirety of epitopes lying in a defined contiguous stretch of an antigen. An epitope cluster can comprise one, two or more epitopes. The epitope clusters that were defined—in the context of the present invention—in the extracellular domain of BCMA are described above and depicted in FIG. 1.

The terms "(capable of) binding to", "specifically recognizing", "directed to" and "reacting with" mean in accordance with this invention that a binding domain is capable of specifically interacting with one or more, preferably at least two, more preferably at least three and most preferably at least four amino acids of an epitope.

As used herein, the terms "specifically interacting", "specifically binding" or "specifically bind(s)" mean that a binding domain exhibits appreciable affinity for a particular protein or antigen and, generally, does not exhibit significant reactivity with proteins or antigens other than BCMA or CD3. "Appreciable affinity" includes binding with an affinity of about $10^{-6}$ M (KD) or stronger. Preferably, binding is considered specific when binding affinity is about $10^{-12}$ to $10^{-8}$ M, $10^{-12}$ to $10^{-9}$ M, $10^{-12}$ to $10^{-10}$ M, $10^{11}$ to $10^{-8}$ M, preferably of about $10^{-11}$ to $10^{-9}$ M. Whether a binding domain specifically reacts with or binds to a target can be tested readily by, inter alia, comparing the reaction of said binding domain with a target protein or antigen with the reaction of said binding domain with proteins or antigens other than BCMA or CD3. Preferably, a binding domain of the invention does not essentially bind or is not capable of binding to proteins or antigens other than BCMA or CD3 (i.e. the first binding domain is not capable of binding to proteins other than BCMA and the second binding domain is not capable of binding to proteins other than CD3).

Specific binding is believed to be effected by specific motifs in the amino acid sequence of the binding domain and the antigen. Thus, binding is achieved as a result of their primary, secondary and/or tertiary structure as well as the result of secondary modifications of said structures. The specific interaction of the antigen-interaction-site with its specific antigen may result in a simple binding of said site to the antigen. Moreover, the specific interaction of the antigen-interaction-site with its specific antigen may alternatively or additionally result in the initiation of a signal, e.g. due to the induction of a change of the conformation of the antigen, an oligomerization of the antigen, etc.

The term "does not essentially bind", or "is not capable of binding" means that a binding domain of the present invention does not bind another protein or antigen other than BCMA or CD3, i.e., does not show reactivity of more than 30%, preferably not more than 20%, not more preferably not more than 10%, particularly preferably not more than 9%, 8%, 7%, 6% or 5% with proteins or antigens other than BCMA or CD3, whereby binding to BCMA or CD3, respectively, is set to be 100%.

"Proteins" (including fragments thereof, preferably biologically active fragments, and peptides, usually having less than 30 amino acids) comprise one or more amino acids coupled to each other via a covalent peptide bond (resulting in a chain of amino acids). The term "polypeptide" as used herein describes a group of molecules, which consist of more than 30 amino acids. Polypeptides may further form multimers such as dimers, trimers and higher oligomers, i.e. consisting of more than one polypeptide molecule. Polypeptide molecules forming such dimers, trimers etc. may be identical or non-identical. The corresponding higher order structures of such multimers are, consequently, termed homo- or heterodimers, homo- or heterotrimers etc. An example for a hereteromultimer is an antibody molecule, which, in its naturally occurring form, consists of two identical light polypeptide chains and two identical heavy polypeptide chains. The terms "polypeptide" and "protein" also refer to naturally modified polypeptides/proteins wherein the modification is effected e.g. by post-translational modifications like glycosylation, acetylation, phosphorylation and the like. A "polypeptide" when referred to herein may also be chemically modified such as pegylated. Such modifications are well known in the art.

The term "amino acid" or "amino acid residue" typically refers to an amino acid having its art recognized definition such as an amino acid selected from the group consisting of: alanine (Ala or A); arginine (Arg or R); asparagine (Asn or N); aspartic acid (Asp or D); cysteine (Cys or C); glutamine (Gln or Q); glutamic acid (Glu or E); glycine (Gly or G); histidine (His or H); isoleucine (He or I); leucine (Leu or L); lysine (Lys or K); methionine (Met or M); phenylalanine (Phe or F); pro line (Pro or P); serine (Ser or S); threonine (Thr or T); tryptophan (Trp or W); tyrosine (Tyr or Y); and valine (Val or V), although modified, synthetic, or rare amino acids may be used as desired. Generally, amino acids can be grouped as having a nonpolar side chain (e.g., Ala, Cys, He, Leu, Met, Phe, Pro, Val); a negatively charged side chain (e.g., Asp, Glu); a positively charged sidechain (e.g., Arg, His, Lys); or an uncharged polar side chain (e.g., Asn, Cys, Gln, Gly, His, Met, Phe, Ser, Thr, Trp, and Tyr).

The definition of the term "antibody" includes embodiments such as monoclonal, chimeric, single chain, humanized and human antibodies. In addition to full-length antibodies, the definition also includes antibody derivatives and antibody fragments, like, inter alia, Fab fragments. Antibody fragments or derivatives further comprise F(ab')$_2$, Fv, scFv fragments or single domain antibodies such as domain antibodies or nanobodies, single variable domain antibodies or immunoglobulin single variable domain comprising merely one variable domain, which might be VHH, VH or VL, that specifically bind an antigen or epitope independently of other V regions or domains; see, for example, Harlow and Lane (1988) and (1999), loc. cit.; Kontermann and Dübel, Antibody Engineering, Springer, 2nd ed. 2010 and Little, Recombinant Antibodies for Immunotherapy, Cambridge University Press 2009. Said term also includes diabodies or Dual-Affinity Re-Targeting (DART) antibodies. Further envisaged are (bispecific) single chain diabody, tandem diabody (Tandab), "minibodies" exemplified by a structure which is as follows: (VH-VL-CH3)$_2$, (scFv-CH3)$_2$ or (scFv-CH3-scFv)$_2$, "Fc DART" and "IgG DART", multibodies such as triabodies.

Immunoglobulin single variable domains encompass not only an isolated antibody single variable domain polypeptide, but also larger polypeptides that comprise one or more monomers of an antibody single variable domain polypeptide sequence.

Various procedures are known in the art and may be used for the production of such antibodies and/or fragments. Thus, (antibody) derivatives can be produced by peptidomimetics. Further, techniques described for the production of single chain antibodies (see, inter alia, U.S. Pat. No. 4,946,778, Kontermann and Dübel (2010), loc. cit. and Little(2009), loc. cit.) can be adapted to produce single chain antibodies specific for elected polypeptide(s). Also, transgenic animals may be used to express humanized antibodies specific for polypeptides and fusion proteins of this invention. For the preparation of monoclonal antibodies, any technique, providing antibodies produced by continuous cell line cultures can be used. Examples for such techniques include the hybridoma technique (Köhler and Milstein Nature 256 (1975), 495-497), the trioma technique, the human B cell hybridoma technique (Kozbor, Immunology Today 4 (1983), 72) and the EBV hybridoma technique to produce human monoclonal antibodies (Cole et al., Monoclonal Antibodies and Cancer Therapy, Alan R. Liss, Inc. (1985), 77-96). Surface plasmon resonance as employed in the BIAcore system can be used to increase the efficiency of phage antibodies which bind to an epitope of a target polypeptide, such as CD3 epsilon (Schier, Human Antibodies Hybridomas 7 (1996), 97-105; Malmborg, J. Immunol. Methods 183 (1995), 7-13). It is also envisaged in the context of this invention that the term "antibody" comprises antibody constructs, which may be expressed in a host as described herein below, e.g. antibody constructs which may be transfected and/or transduced via, inter alia, viruses or plasmid vectors.

Furthermore, the term "antibody" as employed herein also relates to derivatives or variants of the antibodies described herein which display the same specificity as the described antibodies. Examples of "antibody variants" include humanized variants of non-human antibodies, "affinity matured" antibodies (see, e.g. Hawkins et al. J. Mol. Biol. 254, 889-896 (1992) and Lowman et al., Biochemistry 30, 10832-10837 (1991)) and antibody mutants with altered effector function(s) (see, e.g., U.S. Pat. No. 5,648,260, Kontermann and Dübel (2010), loc. cit. and Little(2009), loc. cit.). One exemplary method of making antibodies includes screening protein expression libraries, e.g., phage or ribosome display libraries. Phage display is described, for example, in Ladner et al., U.S. Pat. No. 5,223,409; Smith (1985) Science 228: 1315-1317; Clackson et al., (1991) Nature, 352: 624-628.

In addition to the use of display libraries, the specified antigen can be used to immunize a non-human animal, e.g., a rodent, e.g., a mouse, hamster, or rat. In one embodiment, the non-human animal includes at least a part of a human immunoglobulin gene. For example, it is possible to engineer mouse strains deficient in mouse antibody production with large fragments of the human Ig loci. Using the hybridoma technology, antigen-specific monoclonal antibodies derived from the genes with the desired specificity may be produced and selected. See, e.g., XENOMOUSE™, Green et al. (1994) Nature Genetics 7:13-21, US 2003-0070185, WO 96/34096, and WO96/33735.

An antibody or fragment thereof may also be modified by specific deletion of human T cell epitopes or "deimmunization" by the methods disclosed in WO 98/52976 and WO 00/34317. Briefly, the heavy and light chain variable domains of an antibody can be analyzed for peptides that bind to MHC class II; these peptides represent potential T cell epitopes (as defined in WO 98/52976 and WO 00/34317). For detection of potential T cell epitopes, a computer modeling approach termed "peptide threading" can be applied, and in addition a database of human MHC class II binding peptides can be searched for motifs present in the VH and VL sequences, as described in WO 98/52976 and WO 00/34317. These motifs bind to any of the 18 major MHC class II DR allotypes, and thus constitute potential T cell epitopes. Potential T-cell epitopes detected can be eliminated by substituting small numbers of amino acid residues in the variable domains, or preferably, by single amino acid substitutions. Typically, conservative substitutions are made. Often, but not exclusively, an amino acid common to a position in human germline antibody sequences may be used. Human germline sequences, e.g., are disclosed in Tomlinson, et al., (1992) J. Mol. Biol. 227:776-798; Cook, G. P. et al., (1995) Immunol. Today Vol. 16 (5): 237-242; and Tomlinson et al. (1995) EMBO J. 14: 14:4628-4638. The V BASE directory provides a comprehensive directory of human immunoglobulin variable region sequences (compiled by Tomlinson, L A. et al. MRC Centre for Protein Engineering, Cambridge, UK). These sequences can be used as a source of human sequence, e.g., for framework regions and CDRs. Consensus human framework regions can also be used, e.g., as described in U.S. Pat. No. 6,300,064.

The pairing of a VH and VL together forms a single antigen-binding site. The CH domain most proximal to VH is designated as CH1. Each L chain is linked to an H chain by one covalent disulfide bond, while the two H chains are linked to each other by one or more disulfide bonds depending on the H chain isotype. The VH and VL domains consist of four regions of relatively conserved sequences called framework regions (FR1, FR2, FR3, and FR4), which form a scaffold for three regions of hypervariable sequences (complementarity determining regions, CDRs). The CDRs contain most of the residues responsible for specific interactions of the antibody with the antigen. CDRs are referred to as CDR 1, CDR2, and CDR3. Accordingly, CDR constituents on the heavy chain are referred to as H1, H2, and H3, while CDR constituents on the light chain are referred to as L1, L2, and L3.

The term "variable" refers to the portions of the immunoglobulin domains that exhibit variability in their sequence and that are involved in determining the specificity and binding affinity of a particular antibody (i.e., the "variable domain(s) "). Variability is not evenly distributed throughout the variable domains of antibodies; it is concentrated in sub-domains of each of the heavy and light chain variable regions.

These sub-domains are called "hypervariable" regions or "complementarity determining regions" (CDRs). The more conserved (i.e., non-hypervariable) portions of the variable domains are called the "framework" regions (FRM). The variable domains of naturally occurring heavy and light chains each comprise four FRM regions, largely adopting a β-sheet configuration, connected by three hypervariable regions, which form loops connecting, and in some cases forming part of, the β-sheet structure. The hypervariable regions in each chain are held together in close proximity by the FRM and, with the hypervariable regions from the other chain, contribute to the formation of the antigen-binding site (see Kabat et al., loc. cit.). The constant domains are not directly involved in antigen binding, but exhibit various effector functions, such as, for example, antibody-dependent, cell-mediated cytotoxicity and complement activation.

The term "hypervariable region" (also known as "complementarity determining regions" or CDRs) when used herein refers to the amino acid residues of an antibody which are (usually three or four short regions of extreme sequence variability) within the V-region domain of an immunoglobulin which form the antigen-binding site and are the main determinants of antigen specificity. There are at least two methods for identifying the CDR residues: (1) An approach based on cross-species sequence variability (i.e., Kabat et al., loc. cit.); and (2) An approach based on crystallographic studies of antigen-antibody complexes (Chothia, C. et al., J. Mol. Biol. 196: 901-917 (1987)). However, to the extent that two residue identification techniques define regions of overlapping, but not identical regions, they can be combined to define a hybrid CDR. However, in general, the CDR residues are preferably identified in accordance with the so-called Kabat (numbering) system.

The terms "antigen-binding domain", "antigen-binding fragment" and "antibody binding region" when used herein refer to a part of an antibody molecule that comprises amino acids responsible for the specific binding between antibody and antigen. The part of the antigen that is specifically recognized and bound by the antibody is referred to as the "epitope" as described herein above. As mentioned above, an antigen-binding domain may typically comprise an antibody light chain variable region (VL) and an antibody heavy chain variable region (VH); however, it does not have to comprise both. Fd fragments, for example, have two VH regions and often retain some antigen-binding function of the intact antigen-binding domain. Examples of antigen-binding fragments of an antibody include (1) a Fab fragment, a monovalent fragment having the VL, VH, CL and CH1 domains; (2) a F(ab')2 fragment, a bivalent fragment having two Fab fragments linked by a disulfide bridge at the hinge region; (3) an Fd fragment having the two VH and CH1 domains; (4) an Fv fragment having the VL and VH domains of a single arm of an antibody, (5) a dAb fragment (Ward et al., (1989) Nature 341:544-546), which has a VH domain; (6) an isolated complementarity determining region (CDR), and (7) a single chain Fv (scFv), the latter being preferred (for example, derived from a scFV-library). Although the two domains of the Fv fragment, VL and VH are coded for by separate genes, they can be joined, using recombinant methods, by a synthetic linker that enables them to be made as a single protein chain in which the VL and VH regions pair to form monovalent molecules (known as single chain Fv (scFv); see e.g., Huston et al. (1988) Proc. Natl. Acad. Sci. USA 85:5879-5883). These antibody fragments are obtained using conventional techniques known to those with skill in the art, and the fragments are evaluated for function in the same manner as are intact antibodies.

The term "monoclonal antibody" as used herein refers to an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. Monoclonal antibodies are highly specific, being directed against a single antigenic site. Furthermore, in contrast to conventional (polyclonal) antibody preparations which typically include different antibodies directed against different determinants (epitopes), each monoclonal antibody is directed against a single determinant on the antigen. In addition to their specificity, the monoclonal antibodies are advantageous in that they are synthesized by the hybridoma culture, uncontaminated by other immunoglobulins. The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler et al., Nature, 256: 495 (1975), or may be made by recombinant DNA methods (see, e.g., U.S. Pat. No. 4,816,567). The "monoclonal antibodies" may also be isolated from phage antibody libraries using the techniques described in Clackson et al., Nature, 352: 624-628 (1991) and Marks et al., J. Mol. Biol., 222: 581-597 (1991), for example.

The monoclonal antibodies of the present invention specifically include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain (s) is (are) identical with or homologous to corresponding sequences in antibodies derived from another species or belonging to another antibody class or subclass, as well as fragments of such antibodies, so long as they exhibit the desired biological activity (U.S. Pat. No. 4,816,567; Morrison et al., Proc. Natl. Acad. Sci. USA, 81: 6851-6855 (1984)). Chimeric antibodies of interest herein include "primitized" antibodies comprising variable domain antigen-binding sequences derived from a non-human primate (e.g., Old World Monkey, Ape etc.) and human constant region sequences.

A monoclonal antibody can be obtained from a non-human animal, and then modified, e.g., humanized, deimmunized, chimeric, may be produced using recombinant DNA techniques known in the art. A variety of approaches for making chimeric antibodies have been described. See e.g., Morrison et al., Proc. Natl. Acad. ScL U.S.A. 81:6851, 1985; Takeda et al., Nature 314:452, 1985, Cabilly et al., U.S. Pat. No. 4,816,567; Boss et al., U.S. Pat. No. 4,816,397; Tanaguchi et al., EP 0171496; EP 0173494, GB 2177096.

"Humanized" forms of non-human (e.g., murine) antibodies are chimeric immunoglobulins, immunoglobulin chains or fragments thereof (such as Fv, Fab, Fab', F(ab')2 or other antigen-binding subsequences of antibodies) of mostly human sequences, which contain minimal sequence derived from non-human immunoglobulin. For the most part, humanized antibodies are human immunoglobulins (recipient antibody) in which residues from a hypervariable region (also CDR) of the recipient are replaced by residues from a hypervariable region of a non-human species (donor antibody) such as mouse, rat or rabbit having the desired specificity, affinity, and capacity. In some instances, Fv framework region (FR) residues of the human immunoglobulin are replaced by corresponding non-human residues. Furthermore, "humanized antibodies" as used herein may also comprise residues which are found neither in the recipient antibody nor the donor antibody. These modifications are made to further refine and optimize antibody performance. The humanized antibody optimally also will comprise at least a portion of an immunoglobulin constant region (Fc), typically that of a human immunoglobulin. For further details, see Jones et al., Nature, 321: 522-525 (1986); Reichmann et al., Nature, 332: 323-329 (1988); and Presta, Curr. Op. Struct. Biol., 2: 593-596 (1992).

Humanized antibodies may also be produced, for example, using transgenic mice that express human heavy and light chain genes, but are incapable of expressing the endogenous mouse immunoglobulin heavy and light chain genes. Winter describes an exemplary CDR-grafting method that may be used to prepare the humanized antibodies described herein (U.S. Pat. No. 5,225,539). All of the CDRs of a particular human antibody may be replaced with at least a portion of a non-human CDR, or only some of the CDRs may be replaced with non-human CDRs. It is only necessary to replace the number of CDRs required for binding of the humanized antibody to a predetermined antigen.

Humanized antibodies or fragments thereof can, for example, be generated by replacing sequences of the Fv variable domain that are not directly involved in antigen binding with equivalent sequences from human Fv variable domains. Exemplary methods for generating humanized antibodies or fragments thereof are provided by Morrison (1985) Science 229:1202-1207; by Oi et al. (1986) BioTechniques 4:214; and by U.S. Pat. No. 5,585,089; U.S. Pat. No. 5,693,761; U.S. Pat. No. 5,693,762; U.S. Pat. No. 5,859,205; and U.S. Pat. No. 6,407,213. Those methods include isolating, manipulating, and expressing the nucleic acid sequences that encode all or part of immunoglobulin Fv variable domains from at least one of a heavy or light chain. Such nucleic acids may be obtained from a hybridoma producing an antibody against a predetermined target, as described above, as well as from other sources. The recombinant DNA encoding the humanized antibody molecule can then be cloned into an appropriate expression vector.

A humanized antibody can be optimized by the introduction of conservative substitutions, consensus sequence substitutions, germline substitutions and/or backmutations. Such altered immunoglobulin molecules can be made by any of several techniques known in the art, (e.g., Teng et al., Proc. Natl. Acad. Sci. U.S.A., 80: 7308-7312, 1983; Kozbor et al., Immunology Today, 4: 7279, 1983; Olsson et al., Meth. Enzymol., 92: 3-16, 1982), and may be made according to the teachings of EP 239 400.

The term "human antibody" includes antibodies having variable and constant regions corresponding substantially to human germline immunoglobulin sequences known in the art, including, for example, those described by Kabat et al. (See Kabat et al. (1991) loc. cit.). The human antibodies of the invention may include amino acid residues not encoded by human germline immunoglobulin sequences (e.g., mutations introduced by random or site-specific mutagenesis in vitro or by somatic mutation in vivo), for example in the CDRs, and in particular, CDR3. The human antibody can have at least one, two, three, four, five, or more positions replaced with an amino acid residue that is not encoded by the human germline immunoglobulin sequence.

As used herein, "in vitro generated antibody" refers to an antibody where all or part of the variable region (e.g., at least one CDR) is generated in a non-immune cell selection (e.g., an in vitro phage display, protein chip or any other method in which candidate sequences can be tested for their ability to bind to an antigen). This term thus preferably excludes sequences generated by genomic rearrangement in an immune cell.

A "bispecific" or "bifunctional" antibody or immunoglobulin is an artificial hybrid antibody or immunoglobulin having two different heavy/light chain pairs and two different binding sites. Bispecific antibodies can be produced by a variety of methods including fusion of hybridomas or linking of Fab' fragments. See, e.g., Songsivilai & Lachmann, Clin. Exp. Immunol. 79:315-321 (1990). Numerous methods known to those skilled in the art are available for obtaining antibodies or antigen-binding fragments thereof. For example, antibodies can be produced using recombinant DNA methods (U.S. Pat. No. 4,816,567). Monoclonal antibodies may also be produced by generation of hybridomas (see e.g., Kohler and Milstein (1975) Nature, 256: 495-499) in accordance with known methods. Hybridomas formed in this manner are then screened using standard methods, such as enzyme-linked immunosorbent assay (ELISA) and surface plasmon resonance (BIACORE™) analysis, to identify one or more hybridomas that produce an antibody that specifically binds with a specified antigen. Any form of the specified antigen may be used as the immunogen, e.g., recombinant antigen, naturally occurring forms, any variants or fragments thereof, as well as antigenic peptide thereof.

The terms "CDR", and its plural "CDRs", refer to a complementarity determining region (CDR) of which three make up the binding character of a light chain variable region (CDRL1, CDRL2 and CDRL3) and three make up the binding character of a heavy chain variable region (CDRH1, CDRH2 and CDRH3). CDRs contribute to the functional activity of an antibody molecule and are separated by amino acid sequences that comprise scaffolding or framework regions. The exact definitional CDR boundaries and lengths are subject to different classification and numbering systems. CDRs may therefore be referred to by Kabat, Chothia, contact or any other boundary definitions, including the numbering system described herein. Despite differing boundaries, each of these systems has some degree of overlap in what constitutes the so called "hypervariable regions" within the variable sequences. CDR definitions according to these systems may therefore differ in length and boundary areas with respect to the adjacent framework region. See for example Kabat, Chothia, and/or MacCallum (Kabat et al., loc. cit.; Chothia et al., J. Mol. Biol, 1987, 196: 901; and MacCallum et al., J. Mol. Biol, 1996, 262: 732). However, the numbering in accordance with the so-called Kabat system is preferred.

Typically, CDRs form a loop structure that can be classified as a canonical structure. The term "canonical structure" refers to the main chain conformation that is adopted by the antigen binding (CDR) loops. From comparative structural studies, it has been found that five of the six antigen binding loops have only a limited repertoire of available conformations. Each canonical structure can be characterized by the torsion angles of the polypeptide backbone. Correspondent loops between antibodies may, therefore, have very similar three dimensional structures, despite high amino acid sequence variability in most parts of the loops (Chothia and Lesk, J. Mol. Biol., 1987, 196: 901; Chothia et al., Nature, 1989, 342: 877; Martin and Thornton, J. Mol. Biol, 1996, 263: 800, each of which is incorporated by reference in its entirety). Furthermore, there is a relationship between the adopted loop structure and the amino acid sequences surrounding it. The conformation of a particular canonical class is determined by the length of the loop and the amino acid residues residing at key positions within the loop, as well as within the conserved framework (i.e., outside of the loop). Assignment to a particular canonical class can therefore be made based on the presence of these key amino acid residues. The term "canonical structure" may also include considerations as to the linear sequence of the antibody, for example, as catalogued by Kabat (Kabat et al., loc. cit.). The Kabat numbering scheme (system) is a widely adopted standard for numbering the amino acid residues of an antibody variable domain in a consistent manner and is the preferred scheme applied in the present invention as also mentioned elsewhere herein. Additional structural considerations can also be used to determine the canonical structure of an antibody. For example, those differences not fully reflected by Kabat numbering can be described by the numbering system of Chothia et al and/or revealed by other techniques, for example, crystallography and two or three-dimensional computational modeling. Accordingly, a given antibody sequence may be placed into a canonical class which allows for, among other things, identifying appropriate chassis sequences (e.g., based on a desire to include a variety of canonical structures in a library). Kabat numbering of antibody amino acid sequences and structural considerations as described by Chothia et al., loc. cit. and their implications for construing canonical aspects of antibody structure, are described in the literature.

CDR3 is typically the greatest source of molecular diversity within the antibody-binding site. H3, for example, can be as short as two amino acid residues or greater than 26 amino acids. The subunit structures and three-dimensional configurations of different classes of immunoglobulins are well known in the art. For a review of the antibody structure, see Antibodies: A Laboratory Manual, Cold Spring Harbor Laboratory, eds. Harlow et al., 1988. One of skill in the art will recognize that each subunit structure, e.g., a CH, VH, CL, VL, CDR, FR structure, comprises active fragments, e.g., the portion of the VH, VL, or CDR subunit the binds to the antigen, i.e., the antigen-binding fragment, or, e.g., the portion of the CH subunit that binds to and/or activates, e.g., an Fc receptor and/or complement. The CDRs typically refer to the Kabat CDRs, as described in Sequences of Proteins of immunological Interest, US Department of Health and Human Services (1991), eds. Kabat et al. Another standard for characterizing the antigen binding site is to refer to the hypervariable loops as described by Chothia. See, e.g., Chothia, et al. (1987; J. Mol. Biol. 227:799-817); and Tomlinson et al. (1995) EMBO J. 14: 4628-4638. Still another standard is the AbM definition used by Oxford Molecular's AbM antibody modeling software. See, generally, e.g., Protein Sequence and Structure Analysis of Antibody Variable Domains. In: Antibody Engineering Lab Manual (Ed.: Duebel, S, and Kontermann, R., Springer-Verlag, Heidelberg). Embodiments described with respect to Kabat CDRs can alternatively be implemented using similar described relationships with respect to Chothia hypervariable loops or to the AbM-defined loops.

The sequence of antibody genes after assembly and somatic mutation is highly varied, and these varied genes are estimated to encode $10^{10}$ different antibody molecules (Immunoglobulin Genes, $2^{nd}$ ed., eds. Jonio et al., Academic Press, San Diego, Calif., 1995). Accordingly, the immune system provides a repertoire of immunoglobulins. The term "repertoire" refers to at least one nucleotide sequence derived wholly or partially from at least one sequence encoding at least one immunoglobulin. The sequence(s) may be generated by rearrangement in vivo of the V, D, and J segments of heavy chains, and the V and J segments of light chains. Alternatively, the sequence(s) can be generated from a cell in response to which rearrangement occurs, e.g., in vitro stimulation. Alternatively, part or all of the sequence(s) may be obtained by DNA splicing, nucleotide synthesis, mutagenesis, and other methods, see, e.g., U.S. Pat. No. 5,565,332. A repertoire may include only one sequence or may include a plurality of sequences, including ones in a genetically diverse collection.

The term "framework region" refers to the art-recognized portions of an antibody variable region that exist between the more divergent (i.e., hypervariable) CDRs. Such framework regions are typically referred to as frameworks 1 through 4 (FR1, FR2, FR3, and FR4) and provide a scaffold for the presentation of the six CDRs (three from the heavy chain and three from the light chain) in three dimensional space, to form an antigen-binding surface.

The binding molecule of the present invention is preferably an "isolated" binding molecule. "Isolated" when used to describe the binding molecule disclosed herein, means a binding molecule that has been identified, separated and/or recovered from a component of its production environment. Preferably, the isolated binding molecule is free of association with all other components from its production environment. Contaminant components of its production environment, such as that resulting from recombinant transfected cells, are materials that would typically interfere with diagnostic or therapeutic uses for the polypeptide, and may include enzymes, hormones, and other proteinaceous or nonproteinaceous solutes. In preferred embodiments, the binding molecule will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Ordinarily, however, an isolated antibody will be prepared by at least one purification step.

Amino acid sequence modifications of the binding molecules described herein are contemplated. For example, it may be desirable to improve the binding affinity and/or other biological properties of the antibody. Amino acid sequence variants of the binding molecules are prepared by introducing appropriate nucleotide changes into the binding molecules nucleic acid, or by peptide synthesis.

Such modifications include, for example, deletions from, and/or insertions into, and/or substitutions of, residues within the amino acid sequences of the binding molecules. Any combination of deletion, insertion, and substitution is made to arrive at the final construct, provided that the final construct possesses the desired characteristics. The amino acid changes also may alter post-translational processes of the binding molecules, such as changing the number or position of glycosylation sites. Preferably, 1, 2, 3, 4, 5, 6, 7, 8, 9, or 10 amino acids may be substituted in a CDR, while 1, 2, 3, 4, 5, 6, 7, 8, 9, 10, 11, 12, 13, 14, 15, 16, 17, 18, 19, 20, or 25 amino acids may be substituted in the framework regions (FRs). The substitutions are preferably conservative substitutions as described herein. Additionally or alternatively, 1, 2, 3, 4, 5, or 6 amino acids may be inserted or deleted in each of the CDRs (of course, dependent on their length), while 1, 2, 3, 4, 5, 6, 7, 8, 9, 10, 11, 12, 13, 14, 15, 16, 17, 18, 19, 20, or 25 amino acids may be inserted or deleted in each of the FRs.

A useful method for identification of certain residues or regions of the binding molecules that are preferred locations for mutagenesis is called "alanine scanning mutagenesis" as described by Cunningham and Wells in Science, 244: 1081-1085 (1989). Here, a residue or group of target residues within the binding molecule is/are identified (e.g. charged residues such as arg, asp, his, lys, and glu) and replaced by a neutral or negatively charged amino acid (most preferably alanine or polyalanine) to affect the interaction of the amino acids with the epitope.

Those amino acid locations demonstrating functional sensitivity to the substitutions then are refined by introducing further or other variants at, or for, the sites of substitution. Thus, while the site for introducing an amino acid sequence variation is predetermined, the nature of the mutation per se needs not to be predetermined. For example, to analyze the performance of a mutation at a given site, ala scanning or random mutagenesis is conducted at a target codon or region and the expressed binding molecule variants are screened for the desired activity.

Preferably, amino acid sequence insertions include amino- and/or carboxyl-terminal fusions ranging in length from 1, 2, 3, 4, 5, 6, 7, 8, 9 or 10 residues to polypeptides containing a hundred or more residues, as well as intrasequence insertions of single or multiple amino acid residues. An insertional variant of the binding molecule includes the fusion to the N- or C-terminus of the antibody to an enzyme or a fusion to a polypeptide which increases the serum half-life of the antibody.

Another type of variant is an amino acid substitution variant. These variants have preferably at least 1, 2, 3, 4, 5, 6, 7, 8, 9 or 10 amino acid residues in the binding molecule replaced by a different residue. The sites of greatest interest for substitutional mutagenesis include the CDRs of the heavy and/or light chain, in particular the hypervariable regions, but FR alterations in the heavy and/or light chain are also contemplated.

For example, if a CDR sequence encompasses 6 amino acids, it is envisaged that one, two or three of these amino acids are substituted. Similarly, if a CDR sequence encompasses 15 amino acids it is envisaged that one, two, three, four, five or six of these amino acids are substituted.

Generally, if amino acids are substituted in one or more or all of the CDRs of the heavy and/or light chain, it is preferred that the then-obtained "substituted" sequence is at least 60%, more preferably 65%, even more preferably 70%, particularly preferably 75%, more particularly preferably 80% identical to the "original" CDR sequence. This means that it is dependent of the length of the CDR to which degree it is identical to the "substituted" sequence. For example, a CDR having 5 amino acids is preferably 80% identical to its substituted sequence in order to have at least one amino acid substituted. Accordingly, the CDRs of the binding molecule may have different degrees of identity to their substituted sequences, e.g., CDRL1 may have 80%, while CDRL3 may have 90%.

Preferred substitutions (or replacements) are conservative substitutions. However, any substitution (including non-conservative substitution or one or more from the "exemplary substitutions" listed in Table 1, below) is envisaged as long as the binding molecule retains its capability to bind to BCMA via the first binding domain and to CD3 epsilon via the second binding domain and/or its CDRs have an identity to the then substituted sequence (at least 60%, more preferably 65%, even more preferably 70%, particularly preferably 75%, more particularly preferably 80% identical to the "original" CDR sequence).

Conservative substitutions are shown in Table 1 under the heading of "preferred substitutions". If such substitutions result in a change in biological activity, then more substantial changes, denominated "exemplary substitutions" in Table 1, or as further described below in reference to amino acid classes, may be introduced and the products screened for a desired characteristic.

TABLE 1

Amino Acid Substitutions

| Original | Exemplary Substitutions | Preferred Substitutions |
|---|---|---|
| Ala (A) | val, leu, ile | val |
| Arg (R) | lys, gln, asn | lys |
| Asn (N) | gln, his, asp, lys, arg | gln |
| Asp (D) | glu, asn | glu |
| Cys (C) | ser, ala | ser |
| Gln (Q) | asn, glu | asn |
| Glu (E) | asp, gln | asp |
| Gly (G) | ala | ala |
| His (H) | asn, gln, lys, arg | arg |
| Ile (I) | leu, val, met, ala, phe | leu |
| Leu (L) | norleucine, ile, val, met, ala | ile |
| Lys (K) | arg, gln, asn | arg |
| Met (M) | leu, phe, ile | leu |
| Phe (F) | leu, val, ile, ala, tyr | tyr |
| Pro (P) | ala | ala |
| Ser (S) | thr | thr |
| Thr (T) | ser | ser |
| Trp (W) | tyr, phe | tyr |
| Tyr (Y) | trp, phe, thr, ser | phe |
| Val (V) | ile, leu, met, phe, ala | leu |

Substantial modifications in the biological properties of the binding molecule of the present invention are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties: (1) hydrophobic: norleucine, met, ala, val, leu, ile; (2) neutral hydrophilic: cys, ser, thr; (3) acidic: asp, glu; (4) basic: asn, gin, his, lys, arg; (5) residues that influence chain orientation: gly, pro; and (6) aromatic: trp, tyr, phe.

Non-conservative substitutions will entail exchanging a member of one of these classes for another class. Any cysteine residue not involved in maintaining the proper conformation of the binding molecule may be substituted, generally with serine, to improve the oxidative stability of the molecule and prevent aberrant crosslinking. Conversely, cysteine bond(s) may be added to the antibody to improve its stability (particularly where the antibody is an antibody fragment such as an Fv fragment).

A particularly preferred type of substitutional variant involves substituting one or more hypervariable region residues of a parent antibody (e.g. a humanized or human antibody). Generally, the resulting variant(s) selected for further development will have improved biological properties relative to the parent antibody from which they are generated. A convenient way for generating such substitutional variants involves affinity maturation using phage display. Briefly, several hypervariable region sites (e.g. 6-7 sites) are mutated to generate all possible amino acid substitutions at each site. The antibody variants thus generated are displayed in a monovalent fashion from filamentous phage particles as fusions to the gene III product of M13 packaged within each particle. The phage-displayed variants are then screened for their biological activity (e.g. binding affinity) as herein disclosed. In order to identify candidate hypervariable region sites for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the binding domain and, e.g., human BCMA. Such contact residues and neighbouring residues are candidates for substitution according to the techniques elaborated herein. Once such variants are generated, the panel of variants is subjected to screening as described herein and antibodies with superior properties in one or more relevant assays may be selected for further development.

Other modifications of the binding molecule are contemplated herein. For example, the binding molecule may be linked to one of a variety of non-proteinaceous polymers, e.g., polyethylene glycol, polypropylene glycol, polyoxyalkylenes, or copolymers of polyethylene glycol and polypropylene glycol. The binding molecule may also be entrapped in microcapsules prepared, for example, by coacervation techniques or by interfacial polymerization (for example, hydroxymethylcellulose or gelatine-microcapsules and poly (methylmethacylate) microcapsules, respectively), in colloidal drug delivery systems (for example, liposomes, albumin microspheres, microemulsions, nanoparticles and nanocapsules), or in macroemulsions. Such techniques are disclosed in Remington's Pharmaceutical Sciences, 16th edition, Oslo, A., Ed., (1980).

The binding molecules disclosed herein may also be formulated as immuno-liposomes. A "liposome" is a small vesicle composed of various types of lipids, phospholipids and/or surfactant which is useful for delivery of a drug to a mammal. The components of the liposome are commonly arranged in a bilayer formation, similar to the lipid arrangement of biological membranes. Liposomes containing the antibody are prepared by methods known in the art, such as described in Epstein et al., Proc. Natl. Acad. Sci. USA, 82: 3688 (1985); Hwang et al., Proc. Natl. Acad. Sci. USA, 77: 4030 (1980); U.S. Pat. Nos. 4,485,045 and 4,544,545; and WO 97/38731 published Oct. 23, 1997. Liposomes with enhanced circulation time are disclosed in U.S. Pat. No. 5,013,556. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. Fab' fragments of the antibody of the present invention can be conjugated to the liposomes as described in Martin et al. J. Biol. Chem. 257: 286-288 (1982) via a disulfide interchange reaction. A chemotherapeutic agent is optionally contained within the liposome. See Gabizon et al. J. National Cancer Inst. 81 (19) 1484 (1989).

When using recombinant techniques, the binding molecule can be produced intracellularly, in the periplasmic space, or directly secreted into the medium. If the binding molecule is produced intracellularly, as a first step, the particulate debris, either host cells or lysed fragments, are removed, for example, by centrifugation or ultrafiltration. Carter et al., Bio/Technology 10: 163-167 (1992) describe a procedure for isolating antibodies which are secreted to the periplasmic space of E. coli.

The binding molecule composition prepared from the cells can be purified using, for example, hydroxylapatite chromatography, gel electrophoresis, dialysis, and affinity chromatography, with affinity chromatography being the preferred purification technique.

In a further aspect, the present invention relates to a nucleic acid sequence encoding a binding molecule of the invention. The term "nucleic acid" is well known to the skilled person and encompasses DNA (such as cDNA) and RNA (such as mRNA). The nucleic acid can be double stranded and single stranded, linear and circular. Said nucleic acid molecule is preferably comprised in a vector which is preferably comprised in a host cell. Said host cell is, e.g. after transformation or transfection with the nucleic acid sequence of the invention, capable of expressing the binding molecule. For that purpose the nucleic acid molecule is operatively linked with control sequences.

A vector is a nucleic acid molecule used as a vehicle to transfer (foreign) genetic material into a cell. The term "vector" encompasses—but is not restricted to—plasmids, viruses, cosmids and artificial chromosomes. In general, engineered vectors comprise an origin of replication, a multicloning site and a selectable marker. The vector itself is generally a nucleotide sequence, commonly a DNA sequence, that comprises an insert (transgene) and a larger sequence that serves as the "backbone" of the vector. Modern vectors may encompass additional features besides the transgene insert and a backbone: promoter, genetic marker, antibiotic resistance, reporter gene, targeting sequence, protein purification tag. Vectors called expression vectors (expression constructs) specifically are for the expression of the transgene in the target cell, and generally have control sequences such as a promoter sequence that drives expression of the transgene. Insertion of a vector into the target cell is usually called "transformation" for bacterial cells, "transfection" for eukaryotic cells, although insertion of a viral vector is also called "transduction".

As used herein, the term "host cell" is intended to refer to a cell into which a nucleic acid encoding the binding molecule of the invention is introduced by way of transformation, transfection and the like. It should be understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

As used herein, the term "expression" includes any step involved in the production of a binding molecule of the invention including, but not limited to, transcription, post-transcriptional modification, translation, post-translational modification, and secretion.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

A nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

The terms "host cell," "target cell" or "recipient cell" are intended to include any individual cell or cell culture that can be or has/have been recipients for vectors or the incorporation of exogenous nucleic acid molecules, polynucleotides and/or proteins. It also is intended to include progeny of a single cell, and the progeny may not necessarily be completely identical (in morphology or in genomic or total DNA complement) to the original parent cell due to natural, accidental, or deliberate mutation. The cells may be prokaryotic or eukaryotic, and include but are not limited to bacterial cells, yeast cells, animal cells, and mammalian cells, e.g., murine, rat, macaque or human.

Suitable host cells include prokaryotes and eukaryotic host cells including yeasts, fungi, insect cells and mammalian cells.

The binding molecule of the invention can be produced in bacteria. After expression, the binding molecule of the invention, preferably the binding molecule is isolated from the $E.$ $coli$ cell paste in a soluble fraction and can be purified through, e.g., affinity chromatography and/or size exclusion. Final purification can be carried out similar to the process for purifying antibody expressed e.g, in CHO cells.

In addition to prokaryotes, eukaryotic microbes such as filamentous fungi or yeast are suitable cloning or expression hosts for the binding molecule of the invention. *Saccharomyces cerevisiae*, or common baker's yeast, is the most commonly used among lower eukaryotic host microorganisms. However, a number of other genera, species, and strains are commonly available and useful herein, such as *Schizosaccharomyces pombe*, Kluyveromyces hosts such as, e.g., *K. lactis, K. fragilis* (ATCC 12424), *K. bulgaricus* (ATCC 16045), *K. wickeramii* (ATCC 24178), *K. waltii* (ATCC 56500), *K. drosophilarum* (ATCC 36906), *K. thermotolerans*, and *K. marxianus; yarrowia* (EP 402 226); *Pichia pastoris* (EP 183 070); *Candida; Trichoderma reesia* (EP 244 234); *Neurospora crassa; Schwanniomyces* such as *Schwanniomyces occidentalis*; and filamentous fungi such as, e.g., *Neurospora, Penicillium, Tolypocladium,* and *Aspergillus* hosts such as *A. nidulans* and *A. niger.*

Suitable host cells for the expression of glycosylated binding molecule of the invention, preferably antibody derived binding molecules are derived from multicellular organisms. Examples of invertebrate cells include plant and insect cells. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruit fly), and *Bombyx mori* have been identified. A variety of viral strains for transfection are publicly available, e.g., the L-1 variant of *Autographa californica* NPV and the Bm-5 strain of *Bombyx mori* NPV, and such viruses may be used as the virus herein according to the present invention, particularly for transfection of *Spodoptera frugiperda* cells.

Plant cell cultures of cotton, corn, potato, soybean, petunia, tomato, *Arabidopsis* and tobacco can also be utilized as hosts. Cloning and expression vectors useful in the production of proteins in plant cell culture are known to those of skill in the art. See e.g. Hiatt et al., Nature (1989) 342: 76-78, Owen et al. (1992) Bio/Technology 10: 790-794, Artsaenko et al. (1995) The Plant J 8: 745-750, and Fecker et al. (1996) Plant Mol Biol 32: 979-986.

However, interest has been greatest in vertebrate cells, and propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et al., J. Gen Virol. 36: 59 (1977)); baby hamster kidney cells (BHK, ATCC CCL 10); Chinese hamster ovary cells/−DHFR (CHO, Urlaub et al., Proc. Natl. Acad. Sci. USA 77: 4216 (1980)); mouse sertoli cells (TM4, Mather, Biol. Reprod. 23: 243-251 (1980)); monkey kidney cells (CVI ATCC CCL 70); African green monkey kidney cells (VERO-76, ATCC CRL1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2,1413 8065); mouse mammary tumor (MMT 060562, ATCC CCL51); TR1 cells (Mather et al., Annals N.Y. Acad. Sci. 383: 44-68 (1982)); MRC 5 cells; FS4 cells; and a human hepatoma line (Hep G2).

When using recombinant techniques, the binding molecule of the invention can be produced intracellularly, in the periplasmic space, or directly secreted into the medium. If the binding molecule is produced intracellularly, as a first step, the particulate debris, either host cells or lysed fragments, are removed, for example, by centrifugation or ultrafiltration. Carter et al., Bio/Technology 10: 163-167 (1992) describe a procedure for isolating antibodies which are secreted to the periplasmic space of E. coli. Briefly, cell paste is thawed in the presence of sodium acetate (pH 3.5), EDTA, and phenylmethylsulfonylfluoride (PMSF) over about 30 min. Cell debris can be removed by centrifugation. Where the antibody is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The binding molecule of the invention prepared from the host cells can be purified using, for example, hydroxylapatite chromatography, gel electrophoresis, dialysis, and affinity chromatography, with affinity chromatography being the preferred purification technique.

The matrix to which the affinity ligand is attached is most often agarose, but other matrices are available. Mechanically stable matrices such as controlled pore glass or poly (styrene-divinyl) benzene allow for faster flow rates and shorter processing times than can be achieved with agarose. Where the binding molecule of the invention comprises a CH3 domain, the Bakerbond ABXMresin (J. T. Baker, Phillipsburg, N.J.) is useful for purification. Other techniques for protein purification such as fractionation on an ion-exchange column, ethanol precipitation, Reverse Phase HPLC, chromatography on silica, chromatography on heparin SEPHAROSE™ chromatography on an anion or cation exchange resin (such as a polyaspartic acid column), chromato-focusing, SDS-PAGE, and ammonium sulfate precipitation are also available depending on the antibody to be recovered.

In another aspect, processes are provided for producing binding molecules of the invention, said processes comprising culturing a host cell defined herein under conditions allowing the expression of the binding molecule and recovering the produced binding molecule from the culture.

The term "culturing" refers to the in vitro maintenance, differentiation, growth, proliferation and/or propagation of cells under suitable conditions in a medium.

In an alternative embodiment, compositions are provided comprising a binding molecule of the invention, or produced according to the process of the invention. Preferably, said composition is a pharmaceutical composition.

As used herein, the term "pharmaceutical composition" relates to a composition for administration to a patient, preferably a human patient. The particular preferred pharmaceutical composition of this invention comprises the binding molecule of the invention. Preferably, the pharmaceutical composition comprises suitable formulations of carriers, stabilizers and/or excipients. In a preferred embodiment, the pharmaceutical composition comprises a composition for parenteral, transdermal, intraluminal, intraarterial, intrathecal and/or intranasal administration or by direct injection into tissue. It is in particular envisaged that said composition is administered to a patient via infusion or injection. Administration of the suitable compositions may be effected by different ways, e.g., by intravenous, intraperitoneal, subcutaneous, intramuscular, topical or intradermal administration. In particular, the present invention provides for an uninterrupted administration of the suitable composition. As a non-limiting example, uninterrupted, i.e. continuous administration may be realized by a small pump system worn by the patient for metering the influx of therapeutic agent into the body of the patient. The pharmaceutical composition comprising the binding molecule of the invention can be administered by using said pump systems. Such pump systems are generally known in the art, and commonly rely on periodic exchange of cartridges containing the therapeutic agent to be infused. When exchanging the cartridge in such a pump system, a temporary interruption of the otherwise uninterrupted flow of therapeutic agent into the body of the patient may ensue. In such a case, the phase of administration prior to cartridge replacement and the phase of administration following cartridge replacement would still be considered within the meaning of the pharmaceutical means and methods of the invention together make up one "uninterrupted administration" of such therapeutic agent.

The continuous or uninterrupted administration of these binding molecules of the invention may be intravenous or subcutaneous by way of a fluid delivery device or small pump system including a fluid driving mechanism for driving fluid out of a reservoir and an actuating mechanism for actuating the driving mechanism. Pump systems for subcutaneous administration may include a needle or a cannula for penetrating the skin of a patient and delivering the suitable composition into the patient's body. Said pump systems may be directly fixed or attached to the skin of the patient independently of a vein, artery or blood vessel, thereby allowing a direct contact between the pump system and the skin of the patient. The pump system can be attached to the skin of the patient for 24 hours up to several days. The pump system may be of small size with a reservoir for small volumes. As a non-limiting example, the volume of the reservoir for the suitable pharmaceutical composition to be administered can be between 0.1 and 50 ml.

The continuous administration may be transdermal by way of a patch worn on the skin and replaced at intervals. One of skill in the art is aware of patch systems for drug delivery suitable for this purpose. It is of note that transdermal administration is especially amenable to uninterrupted administration, as exchange of a first exhausted patch can advantageously be accomplished simultaneously with the placement of a new, second patch, for example on the surface of the skin immediately adjacent to the first exhausted patch and immediately prior to removal of the first exhausted patch. Issues of flow interruption or power cell failure do not arise.

The inventive compositions may further comprise a pharmaceutically acceptable carrier. Examples of suitable pharmaceutical carriers are well known in the art and include solutions, e.g. phosphate buffered saline solutions, water, emulsions, such as oil/water emulsions, various types of wetting agents, sterile solutions, liposomes, etc. Compositions comprising such carriers can be formulated by well known conventional methods. Formulations can comprise carbohydrates, buffer solutions, amino acids and/or surfactants. Carbohydrates may be non-reducing sugars, preferably trehalose, sucrose, octasulfate, sorbitol or xylitol. In general, as used herein, "pharmaceutically acceptable carrier" means any and all solvents, dispersion media, coatings, antibacterial and antifungal agents, isotonic and absorption delaying agents, compatible with pharmaceutical administration. The use of such media and agents for pharmaceutically active substances is well known in the art. Acceptable carriers, excipients, or stabilizers are nontoxic to recipients at the dosages and concentrations employed and include: additional buffering agents; preservatives; co-solvents; antioxidants, including ascorbic acid and methionine; chelating agents such as EDTA; metal complexes (e.g., Zn-protein complexes); biodegradable polymers, such as polyesters; salt-forming counter-ions, such as sodium, polyhydric sugar alcohols; amino acids, such as alanine, glycine, asparagine, 2-phenylalanine, and threonine; sugars or sugar alcohols, such as trehalose, sucrose, octasulfate, sorbitol or xylitol stachyose, mannose, sorbose, xylose, ribose, myoinisitose, galactose, lactitol, ribitol, myoinisitol, galactitol, glycerol, cyclitols (e.g., inositol), polyethylene glycol; sulfur containing reducing agents, such as glutathione, thioctic acid, sodium thioglycolate, thioglycerol, [alpha]-monothioglycerol, and sodium thio sulfate; low molecular weight proteins, such as human serum albumin, bovine serum albumin, gelatin, or other immunoglobulins; and hydrophilic polymers, such as polyvinylpyrrolidone. Such formulations may be used for continuous administrations which may be intravenuous or subcutaneous with and/or without pump systems. Amino acids may be charged amino acids, preferably lysine, lysine acetate, arginine, glutamate and/or histidine. Surfactants may be detergents, preferably with a molecular weight of >1.2 KD and/or a polyether, preferably with a molecular weight of >3 KD. Non-limiting examples for preferred detergents are Tween 20, Tween 40, Tween 60, Tween 80 or Tween 85. Non-limiting examples for preferred polyethers are PEG 3000, PEG 3350, PEG 4000 or PEG 5000. Buffer systems used in the present invention can have a preferred pH of 5-9 and may comprise citrate, succinate, phosphate, histidine and acetate.

The compositions of the present invention can be administered to the subject at a suitable dose which can be determined e.g. by dose escalating studies by administration of increasing doses of the polypeptide of the invention exhibiting cross-species specificity described herein to non-chimpanzee primates, for instance macaques. As set forth above, the binding molecule of the invention exhibiting cross-species specificity described herein can be advantageously used in identical form in preclinical testing in non-chimpanzee primates and as drug in humans. These compositions can also be administered in combination with other proteinaceous and non-proteinaceous drugs. These drugs may be administered simultaneously with the composition comprising the polypeptide of the invention as defined herein or separately before or after administration of said polypeptide in timely defined intervals and doses. The dosage regimen will be determined by the attending physician and clinical factors. As is well known in the medical arts, dosages for any one patient depend upon many factors, including the patient's size, body surface area, age, the particular compound to be administered, sex, time and route of administration, general health, and other drugs being administered concurrently.

Preparations for parenteral administration include sterile aqueous or non-aqueous solutions, suspensions, and emulsions. Examples of non-aqueous solvents are propylene glycol, polyethylene glycol, vegetable oils such as olive oil, and injectable organic esters such as ethyl oleate. Aqueous carriers include water, alcoholic/aqueous solutions, emulsions or suspensions, including saline and buffered media. Parenteral vehicles include sodium chloride solution, Ringers dextrose, dextrose and sodium chloride, lactated Ringers, or fixed oils. Intravenous vehicles include fluid and nutrient replenishers, electrolyte replenishers (such as those based on Ringers dextrose), and the like. Preservatives and other additives may also be present such as, for example, antimicrobials, anti-oxidants, chelating agents, inert gases and the like. In addition, the composition of the present invention might comprise proteinaceous carriers, like, e.g., serum albumin or immunoglobulin, preferably of human origin. It is envisaged that the composition of the invention might comprise, in addition to the polypeptide of the invention defined herein, further biologically active agents, depending on the intended use of the composition. Such agents might be drugs acting on the gastro-intestinal system, drugs acting as cytostatica, drugs preventing hyperurikemia, drugs inhibiting immunoreactions (e.g. corticosteroids), drugs modulating the inflammatory response, drugs acting on the circulatory system and/or agents such as cytokines known in the art. It is also envisaged that the binding molecule of the present invention is applied in a co-therapy, i.e., in combination with another anti-cancer medicament.

The biological activity of the pharmaceutical composition defined herein can be determined for instance by cytotoxicity assays, as described in the following examples, in WO 99/54440 or by Schlereth et al. (Cancer Immunol. Immunother. 20 (2005), 1-12). "Efficacy" or "in vivo efficacy" as used herein refers to the response to therapy by the pharmaceutical composition of the invention, using e.g. standardized NCI response criteria. The success or in vivo efficacy of the therapy using a pharmaceutical composition of the invention refers to the effectiveness of the composition for its intended purpose, i.e. the ability of the composition to cause its desired effect, i.e. depletion of pathologic cells, e.g. tumor cells. The in vivo efficacy may be monitored by established standard methods for the respective disease entities including, but not limited to white blood cell counts, differentials, Fluorescence Activated Cell Sorting, bone marrow aspiration. In addition, various disease specific clinical chemistry parameters and other established standard methods may be used. Furthermore, computer-aided tomography, X-ray, nuclear magnetic resonance tomography (e.g. for National Cancer Institute-criteria based response assessment [Cheson B D, Horning S J, Coiffier B, Shipp M A, Fisher R I, Connors J M, Lister T A, Vose J, Grillo-Lopez A, Hagenbeek A, Cabanillas F, Klippensten D, Hiddemann W, Castellino R, Harris N L, Armitage J O, Carter W, Hoppe R, Canellos G P. Report of an international workshop to standardize response criteria for non-Hodgkin's lymphomas. NCI Sponsored International Working Group. J Clin Oncol. 1999 April; 17(4):1244]), positron-emission tomography scanning, white blood cell counts, differentials, Fluorescence Activated Cell Sorting, bone marrow aspiration, lymph node biopsies/histologies, and various lymphoma specific clinical chemistry parameters (e.g. lactate dehydrogenase) and other established standard methods may be used.

Another major challenge in the development of drugs such as the pharmaceutical composition of the invention is the predictable modulation of pharmacokinetic properties. To this end, a pharmacokinetic profile of the drug candidate, i.e. a profile of the pharmacokinetic parameters that affect the ability of a particular drug to treat a given condition, can be established. Pharmacokinetic parameters of the drug influencing the ability of a drug for treating a certain disease entity include, but are not limited to: half-life, volume of distribution, hepatic first-pass metabolism and the degree of blood serum binding. The efficacy of a given drug agent can be influenced by each of the parameters mentioned above.

"Half-life" means the time where 50% of an administered drug are eliminated through biological processes, e.g. metabolism, excretion, etc.

By "hepatic first-pass metabolism" is meant the propensity of a drug to be metabolized upon first contact with the liver, i.e. during its first pass through the liver.

"Volume of distribution" means the degree of retention of a drug throughout the various compartments of the body, like e.g. intracellular and extracellular spaces, tissues and organs, etc. and the distribution of the drug within these compartments.

"Degree of blood serum binding" means the propensity of a drug to interact with and bind to blood serum proteins, such as albumin, leading to a reduction or loss of biological activity of the drug.

Pharmacokinetic parameters also include bioavailability, lag time (Tlag), Tmax, absorption rates, more onset and/or Cmax for a given amount of drug administered. "Bioavailability" means the amount of a drug in the blood compartment. "Lag time" means the time delay between the administration of the drug and its detection and measurability in blood or plasma.

"Tmax" is the time after which maximal blood concentration of the drug is reached, and "Cmax" is the blood concentration maximally obtained with a given drug. The time to reach a blood or tissue concentration of the drug which is required for its biological effect is influenced by all parameters. Pharmacokinetic parameters of bispecific single chain antibodiesexhibiting cross-species specificity, which may be determined in preclinical animal testing in non-chimpanzee primates as outlined above, are also set forth e.g. in the publication by Schlereth et al. (Cancer Immunol. Immunother. 20 (2005), 1-12).

The term "toxicity" as used herein refers to the toxic effects of a drug manifested in adverse events or severe adverse events. These side events might refer to a lack of tolerability of the drug in general and/or a lack of local tolerance after administration. Toxicity could also include teratogenic or carcinogenic effects caused by the drug.

The term "safety", "in vivo safety" or "tolerability" as used herein defines the administration of a drug without inducing severe adverse events directly after administration (local tolerance) and during a longer period of application of the drug. "Safety", "in vivo safety" or "tolerability" can be evaluated e.g. at regular intervals during the treatment and follow-up period. Measurements include clinical evaluation, e.g. organ manifestations, and screening of laboratory abnormalities. Clinical evaluation may be carried out and deviations to normal findings recorded/coded according to NCI-CTC and/or MedDRA standards. Organ manifestations may include criteria such as allergy/immunology, blood/bone marrow, cardiac arrhythmia, coagulation and the like, as set forth e.g. in the Common Terminology Criteria for adverse events v3.0 (CTCAE). Laboratory parameters which may be tested include for instance hematology, clinical chemistry, coagulation profile and urine analysis and examination of other body fluids such as serum, plasma, lymphoid or spinal fluid, liquor and the like. Safety can thus be assessed e.g. by physical examination, imaging techniques (i.e. ultrasound, x-ray, CT scans, Magnetic Resonance Imaging (MRI), other measures with technical devices (i.e. electrocardiogram), vital signs, by measuring laboratory parameters and recording adverse events. For example, adverse events in non-chimpanzee primates in the uses and methods according to the invention may be examined by histopathological and/or histochemical methods.

The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. Amounts effective for this use will depend upon the severity of the infection and the general state of the subject's own immune system. The term "patient" includes human and other mammalian subjects that receive either prophylactic or therapeutic treatment.

The term "effective and non-toxic dose" as used herein refers to a tolerable dose of an inventive binding molecule which is high enough to cause depletion of pathologic cells, tumor elimination, tumor shrinkage or stabilization of disease without or essentially without major toxic effects. Such effective and non-toxic doses may be determined e.g. by dose escalation studies described in the art and should be below the dose inducing severe adverse side events (dose limiting toxicity, DLT).

The above terms are also referred to e.g. in the Preclinical safety evaluation of biotechnology-derived pharmaceuticals S6; ICH Harmonised Tripartite Guideline; ICH Steering Committee meeting on Jul. 16, 1997.

The appropriate dosage, or therapeutically effective amount, of the binding molecule of the invention will depend on the condition to be treated, the severity of the condition, prior therapy, and the patient's clinical history and response to the therapeutic agent. The proper dose can be adjusted according to the judgment of the attending physician such that it can be administered to the patient one time or over a series of administrations. The pharmaceutical composition can be administered as a sole therapeutic or in combination with additional therapies such as anti-cancer therapies as needed.

The pharmaceutical compositions of this invention are particularly useful for parenteral administration, i.e., subcutaneously, intramuscularly, intravenously, intra-articular and/or intra-synovial. Parenteral administration can be by bolus injection or continuous infusion.

If the pharmaceutical composition has been lyophilized, the lyophilized material is first reconstituted in an appropriate liquid prior to administration. The lyophilized material may be reconstituted in, e.g., bacteriostatic water for injection (BWFI), physiological saline, phosphate buffered saline (PBS), or the same formulation the protein had been in prior to lyophilization.

Preferably, the binding molecule of the invention or produced by a process of the invention is used in the prevention, treatment or amelioration of a disease selected from a proliferative disease, a tumorous disease, or an immunological disorder.

An alternative embodiment of the invention provides a method for the prevention, treatment or amelioration of a disease selected from a proliferative disease, a tumorous disease, or an immunological disorder comprising the step of administering to a patient in the need thereof the binding molecule of the invention or produced by a process of the invention.

The formulations described herein are useful as pharmaceutical compositions in the treatment, amelioration and/or prevention of the pathological medical condition as described herein in a patient in need thereof. The term "treatment" refers to both therapeutic treatment and prophylactic or preventative measures. Treatment includes the application or administration of the formulation to the body, an isolated tissue, or cell from a patient who has a disease/disorder, a symptom of a disease/disorder, or a predisposition toward a disease/disorder, with the purpose to cure, heal, alleviate, relieve, alter, remedy, ameliorate, improve, or affect the disease, the symptom of the disease, or the predisposition toward the disease.

Those "in need of treatment" include those already with the disorder, as well as those in which the disorder is to be prevented. The term "disease" is any condition that would benefit from treatment with the protein formulation described herein. This includes chronic and acute disorders or diseases including those pathological conditions that predispose the mammal to the disease in question. Non-limiting examples of diseases/disorders to be treated herein include proliferative disease, a tumorous disease, or an immunological disorder.

Preferably, the binding molecule of the invention is for use in the prevention, treatment or amelioration of B cell disorders that correlate with BCMA (over)expression such as plasma cell disorders, and/or autoimmune diseases. The autoimmune disease is, for example, systemic lupus erythematodes or rheumatoid arthritis.

Cytotoxicity mediated by BCMA/CD3 bispecific binding molecules can be measured in various ways. Effector cells can be e.g. stimulated enriched (human) CD8 positive T cells or unstimulated (human) peripheral blood mononuclear cells (PBMC). If the target cells are of macaque origin or express or are transfected with macaque BCMA, the effector cells should also be of macaque origin such as a macaque T cell line, e.g. 4119LnPx. The target cells should express (at least the extracellular domain of) BCMA, e.g. human or macaque BCMA. Target cells can be a cell line (such as CHO) which is stably or transiently transfected with BCMA, e.g. human or macaque BCMA. Alternatively, the target cells can be a BCMA positive natural expresser cell line, such as the human multiple myeloma cell line L363 or NCI-H929. Usually EC50-values are expected to be lower with target cell lines expressing higher levels of BCMA on the cell surface. The effector to target cell (E:T) ratio is usually about 10:1, but can also vary. Cytotoxic activity of BCMA/CD3 bispecific binding molecules can be measured in an 51-chromium release assay (incubation time of about 18 hours) or in a in a FACS-based cytotoxicity assay (incubation time of about 48 hours). Modifications of the assay incubation time (cytotoxic reaction) are also possible. Other methods of measuring cytotoxicity are well-known to the skilled person and comprise MTT or MTS assays, ATP-based assays including bioluminescent assays, the sulforhodamine B (SRB) assay, WST assay, clonogenic assay and the ECIS technology.

The cytotoxic activity mediated by BCMA/CD3 bispecific binding molecules of the present invention is preferably measured in a cell-based cytotoxicity assay. It is represented by the $EC_{50}$ value, which corresponds to the half maximal effective concentration (concentration of the binding molecule which induces a cytotoxic response halfway between the baseline and maximum).

Also provided by the present invention is a method for the treatment or amelioration of B cell disorders that correlate with BCMA (over)expression such as plasma cell disorders, and/or autoimmune diseases, comprising the step of administering to a subject in need thereof the binding molecule of the invention. The autoimmune disease is, for example, systemic lupus erythematodes or rheumatoid arthritis.

In plasma cell disorders, one clone of plasma cells multiplies uncontrollably. As a result, this clone produces vast amounts of a single (monoclonal) antibody known as the M-protein. In some cases, such as with monoclonal gammopathies, the antibody produced is incomplete, consisting of only light chains or heavy chains. These abnormal plasma cells and the antibodies they produce are usually limited to one type.

Preferably, the plasma cell disorder is selected from the group consisting of multiple myeloma, plasmacytoma, plasma cell leukemia, macroglobulinemia, amyloidosis, Waldenstrom's macroglobulinemia, solitary bone plasmacytoma, extramedullary plasmacytoma, osteosclerotic myeloma, heavy chain diseases, monoclonal gammopathy of undetermined significance, and smoldering multiple myeloma.

In another aspect, kits are provided comprising a binding molecule of the invention, a nucleic acid molecule of the invention, a vector of the invention, or a host cell of the invention. The kit may comprise one or more vials containing the binding molecule and instructions for use. The kit may also contain means for administering the binding molecule of the present invention such as a syringe, pump, infuser or the like, means for reconstituting the binding molecule of the invention and/or means for diluting the binding molecule of the invention.

In another aspect of the invention, the second binding domain is capable of binding to CD3 epsilon. In still another aspect of the invention, the second binding domain is capable of binding to human CD3 and to macaque CD3, preferably to human CD3 epsilon and to macaque CD3 epsilon. Additionally or alternatively, the second binding domain is capable of binding to *Callithrix jacchus, Saguinus oedipus* and/or *Saimiri sciureus* CD3 epsilon. According to these embodiments, one or both binding domains of the binding molecule of the invention are preferably cross-species specific for members of the mammalian order of primates. Cross-species specific CD3 binding domains are, for example, described in WO 2008/119567.

It is particularly preferred for the binding molecule of the present invention that the second binding domain capable of binding to the T cell CD3 receptor complex comprises a VL region comprising CDR-L1, CDR-L2 and CDR-L3 selected from:

(a) CDR-L1 as depicted in SEQ ID NO: 27 of WO 2008/119567, CDR-L2 as depicted in SEQ ID NO: 28 of WO 2008/119567 and CDR-L3 as depicted in SEQ ID NO: 29 of WO 2008/119567;

(b) CDR-L1 as depicted in SEQ ID NO: 117 of WO 2008/119567, CDR-L2 as depicted in SEQ ID NO: 118 of WO 2008/119567 and CDR-L3 as depicted in SEQ ID NO: 119 of WO 2008/119567; and (c) CDR-L1 as depicted in SEQ ID NO: 153 of WO 2008/119567, CDR-L2 as depicted in SEQ ID NO: 154 of WO 2008/119567 and CDR-L3 as depicted in SEQ ID NO: 155 of WO 2008/119567.

In an alternatively preferred embodiment of the binding molecule of the present invention, the second binding domain capable of binding to the T cell CD3 receptor complex com prises a VH region comprising CDR-H1, CDR-H2 and CDR-H3 selected from:
(a) CDR-H1 as depicted in SEQ ID NO: 12 of WO 2008/119567, CDR-H2 as depicted in SEQ ID NO: 13 of WO 2008/119567 and CDR-H3 as depicted in SEQ ID NO: 14 of WO 2008/119567;
(b) CDR-H1 as depicted in SEQ ID NO: 30 of WO 2008/119567, CDR-H2 as depicted in SEQ ID NO: 31 of WO 2008/119567 and CDR-H3 as depicted in SEQ ID NO: 32 of WO 2008/119567;
(c) CDR-H1 as depicted in SEQ ID NO: 48 of WO 2008/119567, CDR-H2 as depicted in SEQ ID NO: 49 of WO 2008/119567 and CDR-H3 as depicted in SEQ ID NO: 50 of WO 2008/119567;
(d) CDR-H1 as depicted in SEQ ID NO: 66 of WO 2008/119567, CDR-H2 as depicted in SEQ ID NO: 67 of WO 2008/119567 and CDR-H3 as depicted in SEQ ID NO: 68 of WO 2008/119567;
(e) CDR-H1 as depicted in SEQ ID NO: 84 of WO 2008/119567, CDR-H2 as depicted in SEQ ID NO: 85 of WO 2008/119567 and CDR-H3 as depicted in SEQ ID NO: 86 of WO 2008/119567;
(f) CDR-H1 as depicted in SEQ ID NO: 102 of WO 2008/119567, CDR-H2 as depicted in SEQ ID NO: 103 of WO 2008/119567 and CDR-H3 as depicted in SEQ ID NO: 104 of WO 2008/119567;
(g) CDR-H1 as depicted in SEQ ID NO: 120 of WO 2008/119567, CDR-H2 as depicted in SEQ ID NO: 121 of WO 2008/119567 and CDR-H3 as depicted in SEQ ID NO: 122 of WO 2008/119567;
(h) CDR-H1 as depicted in SEQ ID NO: 138 of WO 2008/119567, CDR-H2 as depicted in SEQ ID NO: 139 of WO 2008/119567 and CDR-H3 as depicted in SEQ ID NO: 140 of WO 2008/119567;
(i) CDR-H1 as depicted in SEQ ID NO: 156 of WO 2008/119567, CDR-H2 as depicted in SEQ ID NO: 157 of WO 2008/119567 and CDR-H3 as depicted in SEQ ID NO: 158 of WO 2008/119567; and
(j) CDR-H1 as depicted in SEQ ID NO: 174 of WO 2008/119567, CDR-H2 as depicted in SEQ ID NO: 175 of WO 2008/119567 and CDR-H3 as depicted in SEQ ID NO: 176 of WO 2008/119567.

It is further preferred for the binding molecule of the present invention that the second binding domain capable of binding to the T cell CD3 receptor complex comprises a VL region selected from the group consisting of a VL region as depicted in SEQ ID NO: 35, 39, 125, 129, 161 or 165 of WO 2008/119567.

It is alternatively preferred that the second binding domain capable of binding to the T cell CD3 receptor complex comprises a VH region selected from the group consisting of a VH region as depicted in SEQ ID NO: 15, 19, 33, 37, 51, 55, 69, 73, 87, 91, 105, 109, 123, 127, 141, 145, 159, 163, 177 or 181 of WO 2008/119567.

More preferably, the binding molecule of the present invention is characterized by the second binding domain capable of binding to the T cell CD3 receptor complex comprising a VL region and a VH region selected from the group consisting of:
(a) a VL region as depicted in SEQ ID NO: 17 or 21 of WO 2008/119567 and a VH region as depicted in SEQ ID NO: 15 or 19 of WO 2008/119567;
(b) a VL region as depicted in SEQ ID NO: 35 or 39 of WO 2008/119567 and a VH region as depicted in SEQ ID NO: 33 or 37 of WO 2008/119567;
(c) a VL region as depicted in SEQ ID NO: 53 or 57 of WO 2008/119567 and a VH region as depicted in SEQ ID NO: 51 or 55 of WO 2008/119567;
(d) a VL region as depicted in SEQ ID NO: 71 or 75 of WO 2008/119567 and a VH region as depicted in SEQ ID NO: 69 or 73 of WO 2008/119567;
(e) a VL region as depicted in SEQ ID NO: 89 or 93 of WO 2008/119567 and a VH region as depicted in SEQ ID NO: 87 or 91 of WO 2008/119567;
(f) a VL region as depicted in SEQ ID NO: 107 or 111 of WO 2008/119567 and a VH region as depicted in SEQ ID NO: 105 or 109 of WO 2008/119567;
(g) a VL region as depicted in SEQ ID NO: 125 or 129 of WO 2008/119567 and a VH region as depicted in SEQ ID NO: 123 or 127 of WO 2008/119567;
(h) a VL region as depicted in SEQ ID NO: 143 or 147 of WO 2008/119567 and a VH region as depicted in SEQ ID NO: 141 or 145 of WO 2008/119567;
(i) a VL region as depicted in SEQ ID NO: 161 or 165 of WO 2008/119567 and a VH region as depicted in SEQ ID NO: 159 or 163 of WO 2008/119567; and
(j) a VL region as depicted in SEQ ID NO: 179 or 183 of WO 2008/119567 and a VH region as depicted in SEQ ID NO: 177 or 181 of WO 2008/119567.

According to a preferred embodiment of the binding molecule of the present invention, in particular the second binding domain capable of binding to the T cell CD3 receptor complex, the pairs of VH-regions and VL-regions are in the format of a single chain antibody (scFv). The VH and VL regions are arranged in the order VH-VL or VL-VH. It is preferred that the VH-region is positioned N-terminally to a linker sequence. The VL-region is positioned C-terminally of the linker sequence.

A preferred embodiment of the above described binding molecule of the present invention is characterized by the second binding domain capable of binding to the T cell CD3 receptor complex comprising an amino acid sequence selected from the group consisting of SEQ ID NOs: 23, 25, 41, 43, 59, 61, 77, 79, 95, 97, 113, 115, 131, 133, 149, 151, 167, 169, 185 or 187 of WO 2008/119567.

In one embodiment, the first or the second binding domain is or is derived from an antibody. In another embodiment, both binding domains are or are derived from an antibody.

It is also preferred for the binding molecule of the invention that first and the second domain form a molecule that is selected from the group of (scFv)$_2$, (single domain mAb)$_2$, scFv-single domain mAb, diabody or oligomeres thereof.

It is furthermore envisaged that the BCMA/CD3 bispecific binding molecules of the present invention are capable of exhibiting therapeutic efficacy or anti-tumor activity. This can be assessed e.g. in a study as disclosed in the appended Examples, e.g. in Example A19 (advanced stage human tumor xenograft model). The skilled person knows how to modify or adapt certain parameters of this study, such as the number of injected tumor cells, the site of injection, the number of transplanted human T cells, the amount of BCMA/CD3 bispecific binding molecules to be administered, and the timelines, while still arriving at a meaningful and reproducible result. Preferably, the tumor growth inhibition T/C [%] is 70 or 60 or lower, more preferably 50 or 40 or lower, even more preferably at least 30 or 20 or lower and most preferably 10 or lower, 5 or lower or even 2.5 or lower.

Preferably, the BCMA/CD3 bispecific binding molecules of the present invention do not induce/mediate lysis or do not essentially induce/mediate lysis of BCMA negative cells such as HL60, MES-SA, and SNU-16. The term "do not induce lysis", "do not essentially induce lysis", "do not mediate lysis" or "do not essentially mediate lysis" means that a binding molecule of the present invention does not induce or mediate lysis of more than 30%, preferably not more than 20%, more preferably not more than 10%, particularly preferably not more than 9%, 8%, 7%, 6% or 5% of BCMA negative cells, whereby lysis of a BCMA positive cell line such as NCI-H929, L-363 or OPM-2 is set to be 100%. This applies for concentrations of the binding molecule of at least up to 500 nM. The skilled person knows how to measure cell lysis without further ado. Moreover, the specification teaches a specific instruction how to measure cell lysis; see e.g. Example A20 below.

The present invention also provides binding molecules comprising any one of the amino acid sequences shown in SEQ ID NOs: 1-1000 and 1022-1093.

Preferably, a binding molecule comprises three VH CDR sequences (named "VH CDR1", "VH CDR2", "VH CDR3", see $4^{th}$ column of the appended Sequence Table) from a binding molecule termed "BCMA-(X)", wherein X is 1-100 (see $2^{nd}$ column of the appended Sequence Table) and/or three VL CDR sequences (named "VL CDR1", "VH CDR2", "VH CDR3", see $4^{th}$ column of the appended Sequence Table) from a binding molecule term BCMA-X, wherein X is 1-100 (see $2^{nd}$ column of the appended Sequence Table).

Preferably, a binding molecule comprises a VH and/or VL sequence as is given in the appended Sequence Table (see $4^{th}$ column of the appended Sequence Table: "VH" and "VL"). Preferably, a binding molecule comprises a scFV sequence as is given in the appended Sequence Table (see $4^{th}$ column of the appended Sequence Table: "scFv").

Preferably, a binding molecule comprises a bispecific molecule sequence as is given in the appended Sequence Table (see $4^{th}$ column of the appended Sequence Table: "bispecific molecule").

The present invention also relates to a bispecific binding agent comprising at least two binding domains, comprising a first binding domain and a second binding domain, wherein said first binding domain binds to the B cell maturation antigen BCMA and wherein said second binding domain binds to CD3 (general item 1) also including the following general items (G1):

GI 2. The bispecific binding agent of item 1, wherein said first binding domaibinds to the extracellular domain of BCMA and said second binding domain binds to the ϵ chain of CD3.

GI 3. A bispecific binding agent of general item 1 or 2 which is in the format of a full-length antibody or an antibody fragment.

GI 4. A bispecific binding agent of general item 3 in the format of a full-length antibody, wherein said first BCMA-binding domain is derived from mouse said and wherein said second CD3-binding domain is derived from rat.

GI 5. A bispecific binding agent of general item 3, which is in the format of an antibody fragment in the form of a diabody that comprises a heavy chain variable domain connected to a light chain variable domain on the same polypeptide chain such that the two domains do not pair.

GI 6. A bispecific binding agent of general item 1 or 2 which is in the format of a bispecific single chain antibody that consists of two scFv molecules connected via a linker peptide or by a human serum albumin molecule.

GI 7. The bispecific binding agent of general item 6, heavy chain regions (VH) and the corresponding variable light chain regions (VL) are arranged, from N-terminus to C-terminus, in the order
VH(BCMA)-VL(BCMA)-VH(CD3)-VL(CD3),
VH(CD3)-VL(CD3)-VH(BCMA)-VL(BCMA) or
VH CD3)-VL(CD3)-VL(BCMA)-VH(BCMA).

GI 8. A bispecific binding agent of general item 1 or 2, which is in the format of a single domain immunoglobulin domain selected from VHHs or VHs.

GI 9. The bispecific binding agent of general item 1 or 2, which is in the format of an Fv molecule that has four antibody variable domains with at least two binding domains, wherein at least one binding domain is specific to human BCMA and at least one binding domain is specific to human CD3.

GI 10. A bispecific binding agent of general item 1 or 2, which is in the format of a single-chain binding molecule consisting of a first binding domain specific for BCMA, a constant sub-region that is located C-terminal to said first binding domain, a scorpion linker located C-terminal to the constant sub-region, and a second binding domain specific for CD3, which is located C-terminal to said constant sub-region.

GI 11. The bispecific binding agent of general item 1 or 2, which is in the format of an antibody-like molecule that binds to BCMA via the two heavy chain/light chain Fv of an antibody or an antibody fragment and which binds to CD3 via a binding domain that has been engineered into non-CDR loops of the heavy chain or the light chain of said antibody or antibody fragment.

GI 12. A bispecific binding agent of item 1 which is in the format of a bispecific ankyrin repeat molecule.

GI 13. A bispecific binding agent of general item 1, wherein said first binding domain has a format selected from the formats defined in any one of items 3 to 12 and wherein said second binding domain has a different format selected from the formats defined in any one of items 3 to 12.

GI 14. A bispecific binding agent of general item 1 which is a bicyclic peptide.

GI 15. A pharmaceutical composition containing at least one bispecific binding agent of any one of general items 1 to 14.

GI 16. A bispecific binding agent of any one of general items 1 to 14 or a pharmaceutical composition of item 14 for the treatment of plasma cell disorders or other B cell disorders that correlate with BCMA expression and for the treatment of autoimmune diseases.

GI 17. A bispecific binding agent of any one of general items 1 to 14 or a pharmaceutical composition of item 15 for the treatment of plasma cell disorders selected from plasmacytoma, plasma cell leukemia, multiple myeloma, macroglobulinemia, amyloidosis, Waldenstrom's macroglobulinemia, solitary bone plasmacytoma, extramedullary plasmacytoma, osteosclerotic myeloma, heavy chain diseases, monoclonal gammopathy of undetermined significance, smoldering multiple myeloma.

Variations of the above items are derivable from EP-Nr. 10 191 418.2 which are also included herein.

DETAILED DESCRIPTION

The present invention specifically relates to groups of binding molecules which are grouped together as follows. The definitions, embodiments and/or aspects as described above are applicable to the group of binding molecules that follow.

First Group of Binding Molecules (A)

The first group of binding molecules comprises a first and a second binding domain, wherein the first binding domain is capable of binding to epitope cluster 3 and to epitope cluster 4 of BCMA, and the second binding domain is capable of binding to the T cell CD3 receptor complex.

Thus, in a first aspect the present invention provides a binding molecule which is at least bispecific comprising a first and a second binding domain, wherein (a) the first binding domain is capable of binding to epitope cluster 3 and to epitope cluster 4 of BCMA; and
(b) the second binding domain is capable of binding to the T cell CD3 receptor complex; and
wherein epitope cluster 3 of BCMA corresponds to amino acid residues 24 to 41 of the sequence as depicted in SEQ ID NO: 1002, and epitope cluster 4 of BCMA corresponds to amino acid residues 42 to 54 of the sequence as depicted in SEQ ID NO: 1002.

It is also envisaged that the first binding domain of the present invention is able to bind concomitantly to epitope cluster 3 (SEQ ID NO: 1016) and 4 (SEQ ID NO: 1019) of human BCMA In a further aspect, the first binding domain of the binding molecule of the present invention is not capable of binding to the chimeric extracellular domain of BCMA as depicted in SEQ ID NO: 1015. In other words, epitope cluster E7, or more specifically, amino acid residue 39 (arginine) of SEQ ID NO: 1002, plays an important antigenic role in the binding of the first binding domain to BCMA. If this amino acid is exchanged by another amino acid, preferably by way of a non-conservative substitution, such as a substitution with proline or alanine, the first binding domain of the binding molecule of the present invention is not capable of binding to the extracellular domain of BCMA anymore.

The term "is not capable of binding" means that the first binding domain of the binding molecule of the present invention does not bind to the human/murine chimeric BCMA e.g. as depicted in SEQ ID NO: 1015, i.e., does not show reactivity of more than 30%, preferably more than 20%, more preferably more than 10%, particularly preferably more than 9%, 8%, 7%, 6% or 5%, preferably under the conditions applied in the appended Examples A, with the human/murine chimeric BCMA e.g. as depicted in SEQ ID NO: 1015.

In one aspect, the first binding domain of the present invention is capable of binding to epitope cluster 3 and 4 of human BCMA, preferably human BCMA ECD. Accordingly, when the respective epitope cluster in the human BCMA protein is exchanged with the respective epitope cluster of a murine BCMA antigen (resulting in a construct comprising human BCMA, wherein human epitope cluster 3 and/or 4 is replaced with the respective murine epitope cluster; see exemplarily SEQ ID NO: 1011 and 1012, respectively), a decrease in the binding of the binding domain will occur. Said decrease is preferably at least 10%, 20%, 30%, 40%, 50%; more preferably at least 60%, 70%, 80%, 90%, 95% or even 100% in comparison to the respective epitope cluster in the human BCMA protein, whereby binding to the respective epitope cluster in the human BCMA protein is set to be 100%. It is envisaged that the aforementioned human BCMA/murine BCMA chimeras are expressed in CHO cells. It is also envisaged that at least one of the human BCMA/murine BCMA chimeras, preferably the murine E3/human BCMA chimera is fused with a transmembrane domain and/or cytoplasmic domain of a different membrane-bound protein such as EpCAM; see FIG. 2a. A method to test this loss of binding due to exchange with the respective epitope cluster of a non-human (e.g. murine) BCMA antigen is described in the appended Examples A, in particular in Examples A1-A3. A further method to determine the contribution of a specific residue of a target antigen to the recognition by a given binding molecule or binding domain is alanine scanning (see e.g. Morrison K L & Weiss G A. Cur Opin Chem. Biol. 2001 June; 5(3):302-7), where each residue to be analyzed is replaced by alanine, e.g. via site-directed mutagenesis. Alanine is used because of its non-bulky, chemically inert, methyl functional group that nevertheless mimics the secondary structure references that many of the other amino acids possess. Sometimes bulky amino acids such as valine or leucine can be used in cases where conservation of the size of mutated residues is desired. Alanine scanning is a mature technology which has been used for a long period of time. In one aspect, the first binding domain of the present invention binds to epitope cluster 3 and 4 of human BCMA and is further capable of binding to macaque BCMA, preferably to epitope cluster 3 and/or 4 of macaque BCMA (SEQ ID NO:1020 and 1021, respectively) such as from *Macaca mulatta* or *Macaca fascicularis*. It is envisaged that the first binding domain does or does not bind to murine BCMA.

Accordingly, in one embodiment, a binding domain which binds to human BCMA, in particular to epitope cluster 3 and 4 of the extracellular protein domain of BCMA formed by amino acid residues 24 to 41 and 42 to 54, respectively, of the human sequence as depicted in SEQ ID NO: 1002, also binds to macaque BCMA, in particular to epitope cluster 3 and/or 4 of the extracellular protein domain of BCMA formed by amino acid residues 24 to 41 and 42 to 54, respectively, of the macaque BCMA sequence as depicted in SEQ ID NO: 1006.

In one embodiment, a first binding domain of a binding molecule is capable of binding to epitope cluster 3 and 4 of BCMA, wherein epitope cluster 3 and 4 of BCMA corresponds to amino acid residues 24 to 40 and 41 to 53, respectively, of the sequence as depicted in SEQ ID NO: 1002 (human BCMA full-length polypeptide) or SEQ ID NO: 1007 (human BCMA extracellular domain: amino acids 1-54 of SEQ ID NO: 1002).

In one aspect of the present invention, the first binding domain of the binding molecule is additionally or alternatively capable of binding to epitope cluster 3 and/or 4 of *Caffithrix jacchus*, *Saguinus oedipus* and/or *Saimiri sciureus* BCMA.

The affinity of the first binding domain for human BCMA is preferably ≤40 nM, more preferably ≤35 nM, ≤15 nM, or ≤10 nM, even more preferably ≤5 nM, even more preferably ≤1 nM, even more preferably ≤0.5 nM, even more preferably ≤0.1 nM, and most preferably ≤0.05 nM. The affinity of the first binding domain for macaque BCMA is preferably ≤15 nM, more preferably ≤10 nM, even more preferably ≤5 nM, even more preferably ≤1 nM, even more preferably 0.5 nM, even more preferably ≤0.1 nM, and most preferably ≤0.05 nM or even ≤0.01 nM. The affinity can be measured for example in a Biacore assay or in a Scatchard assay, e.g. as described in the Examples. The affinity gap for binding to macaque BCMA versus human BCMA is preferably [1:10-1:5] or [5:1-10:1], more preferably [1:5-5:1], and most preferably [1:2-3:1] or even [1:1-3:1]. Other methods of determining the affinity are well-known to the skilled person.

Cytotoxicity mediated by BCMA/CD3 bispecific binding molecules can be measured in various ways. Effector cells can be e.g. stimulated enriched (human) CD8 positive T cells or unstimulated (human) peripheral blood mononuclear cells (PBMC). If the target cells are of macaque origin or express or are transfected with macaque BCMA, the effector cells should also be of macaque origin such as a macaque T cell line, e.g. 4119LnPx. The target cells should express (at least the extracellular domain of) BCMA, e.g. human or macaque BCMA. Target cells can be a cell line (such as CHO) which is stably or transiently transfected with BCMA, e.g. human or macaque BCMA. Alternatively, the target cells can be a BCMA positive natural expresser cell line, such as the human multiple myeloma cell line L363 or NCI-H929. Usually EC50-values are expected to be lower with target cell lines expressing higher levels of BCMA on the cell surface. The effector to target cell (E:T) ratio is usually about 10:1, but can also vary. Cytotoxic activity of BCMA/CD3 bispecific binding molecules can be measured in an 51-chromium release assay (incubation time of about 18 hours) or in a in a FACS-based cytotoxicity assay (incubation time of about 48 hours). Modifications of the assay incubation time (cytotoxic reaction) are also possible. Other methods of measuring cytotoxicity are well-known to the skilled person and comprise MTT or MTS assays, ATP-based assays including bioluminescent assays, the sulforhodamine B (SRB) assay, WST assay, clonogenic assay and the ECIS technology.

The cytotoxic activity mediated by BCMA/CD3 bispecific binding molecules of the present invention is preferably measured in a cell-based cytotoxicity assay. It is represented by the $EC_{50}$ value, which corresponds to the half maximal effective concentration (concentration of the binding molecule which induces a cytotoxic response halfway between the baseline and maximum). Preferably, the $EC_{50}$ value of the BCMA/CD3 bispecific binding molecules is ≤20.000 pg/ml, more preferably ≤5000 pg/ml, even more preferably ≤1000 pg/ml, even more preferably ≤500 pg/ml, even more preferably ≤250 pg/ml, even more preferably ≤100 pg/ml, even more preferably ≤50 pg/ml, even more preferably ≤10 pg/ml, and most preferably ≤5 pg/ml.

Any of the above given $EC_{50}$ values can be combined with any one of the indicated scenarios of a cell-based cytotoxicity assay. For example, when (human) CD8 positive T cells or a macaque T cell line are used as effector cells, the $EC_{50}$ value of the BCMA/CD3 bispecific binding molecule is preferably ≤1000 pg/ml, more preferably ≤500 pg/ml, even more preferably ≤250 pg/ml, even more preferably ≤100 pg/ml, even more preferably ≤50 pg/ml, even more preferably ≤10 pg/ml, and most preferably ≤5 pg/ml. If in this assay the target cells are (human or macaque) BCMA transfected cells such as CHO cells, the $EC_{50}$ value of the BCMA/CD3 bispecific binding molecule is preferably ≤150 pg/ml, more preferably ≤100 pg/ml, even more preferably ≤50 pg/ml, even more preferably ≤30 pg/ml, even more preferably ≤10 pg/ml, and most preferably ≤5 pg/ml. If the target cells is a BCMA positive natural expresser cell line, then the $EC_{50}$ value is preferably ≤250 pg/ml, even more preferably ≤200 pg/ml, even more preferably ≤100 pg/ml, even more preferably ≤150 pg/ml, even more preferably ≤100 pg/ml, and most preferably ≤50 pg/ml, or lower. When (human) PBMCs are used as effector cells, the $EC_{50}$ value of the BCMA/CD3 bispecific binding molecule is preferably ≤1000 pg/ml, more preferably ≤750 pg/ml, more preferably ≤500 pg/ml, even more preferably ≤250 pg/ml, even more preferably ≤100 pg/ml, and most preferably ≤50 pg/ml, or lower.

The difference in cytotoxic activity between the monomeric and the dimeric isoform of individual BCMA/CD3 bispecific binding molecules (such as antibodies) is referred to as "potency gap". This potency gap can e.g. be calculated as ratio between $EC_{50}$ values of the molecule's monomer and dimer. Potency gaps of the tested BCMA/CD3 bispecific binding molecules of the present invention are preferably ≤5, more preferably ≤4, even more preferably ≤3, even more preferably ≤2 and most preferably ≤1.

Preferably, the BCMA/CD3 bispecific binding molecules of the present invention do not bind to or cross-react with human BAFF-R and/or human TACI. Methods to detect cross-reactivity with human BAFF-R and/or human TACI are disclosed in Example A9.

It is also preferred that the BCMA/CD3 bispecific binding molecules of the present invention have dimer percentages of equal to or less than 1.5%, preferably equal to or less than 0.8% after three freeze/thaw cycles. A freeze-thaw cycle and the determination of the dimer percentage can be determined in accordance with Example A16.

The BCMA/CD3 bispecific binding molecules (such as antibodies) of the present invention preferably show a favorable thermostability with melting temperatures above 60° C., more preferably between 62° C. and 63° C. (see Example A17).

To determine potential interaction of BCMA/CD3 bispecific binding molecules (such as antibodies) with human plasma proteins, a plasma interference test can be carried out (see e.g. Example A18). In a preferred embodiment, there is no significant reduction of target binding of the BCMA/CD3 bispecific binding molecules mediated by plasma proteins. The relative plasma interference value is preferably ≤2.

In one embodiment, the first binding domain of the binding molecule of the invention comprises a VH region comprising CDR-H1, CDR-H2 and CDR-H3 and a VL region comprising CDR-L1, CDR-L2 and CDR-L3 selected from the group consisting of:

(a) CDR-H1 as depicted in SEQ ID NO: 231, CDR-H2 as depicted in SEQ ID NO: 232, CDR-H3 as depicted in SEQ ID NO: 233, CDR-L1 as depicted in SEQ ID NO: 234, CDR-L2 as depicted in SEQ ID NO: 235 and CDR-L3 as depicted in SEQ ID NO: 236;

(b) CDR-H1 as depicted in SEQ ID NO: 241, CDR-H2 as depicted in SEQ ID NO: 242, CDR-H3 as depicted in SEQ ID NO: 243, CDR-L1 as depicted in SEQ ID NO: 244, CDR-L2 as depicted in SEQ ID NO: 245 and CDR-L3 as depicted in SEQ ID NO: 246;

(c) CDR-H1 as depicted in SEQ ID NO: 251, CDR-H2 as depicted in SEQ ID NO: 252, CDR-H3 as depicted in SEQ ID NO: 253, CDR-L1 as depicted in SEQ ID NO: 254, CDR-L2 as depicted in SEQ ID NO: 255 and CDR-L3 as depicted in SEQ ID NO: 256;

(d) CDR-H1 as depicted in SEQ ID NO: 261, CDR-H2 as depicted in SEQ ID NO: 262, CDR-H3 as depicted in SEQ ID NO: 263, CDR-L1 as depicted in SEQ ID NO: 264, CDR-L2 as depicted in SEQ ID NO: 265 and CDR-L3 as depicted in SEQ ID NO: 266;

(e) CDR-H1 as depicted in SEQ ID NO: 271, CDR-H2 as depicted in SEQ ID NO: 272, CDR-H3 as depicted in SEQ ID NO: 273, CDR-L1 as depicted in SEQ ID NO: 274, CDR-L2 as depicted in SEQ ID NO: 275 and CDR-L3 as depicted in SEQ ID NO: 276;

(f) CDR-H1 as depicted in SEQ ID NO: 281, CDR-H2 as depicted in SEQ ID NO: 282, CDR-H3 as depicted in SEQ ID NO: 283, CDR-L1 as depicted in SEQ ID NO: 284, CDR-L2 as depicted in SEQ ID NO: 285 and CDR-L3 as depicted in SEQ ID NO: 286;

(g) CDR-H1 as depicted in SEQ ID NO: 291, CDR-H2 as depicted in SEQ ID NO: 292, CDR-H3 as depicted in SEQ ID NO: 293, CDR-L1 as depicted in SEQ ID NO: 294, CDR-L2 as depicted in SEQ ID NO: 295 and CDR-L3 as depicted in SEQ ID NO: 296;

(h) CDR-H1 as depicted in SEQ ID NO: 301, CDR-H2 as depicted in SEQ ID NO: 302, CDR-H3 as depicted in SEQ ID NO: 303, CDR-L1 as depicted in SEQ ID NO: 304, CDR-L2 as depicted in SEQ ID NO: 305 and CDR-L3 as depicted in SEQ ID NO: 306;

(i) CDR-H1 as depicted in SEQ ID NO: 391, CDR-H2 as depicted in SEQ ID NO: 392, CDR-H3 as depicted in SEQ ID NO: 393, CDR-L1 as depicted in SEQ ID NO: 394, CDR-L2 as depicted in SEQ ID NO: 395 and CDR-L3 as depicted in SEQ ID NO: 396;

(k) CDR-H1 as depicted in SEQ ID NO: 401, CDR-H2 as depicted in SEQ ID NO: 402, CDR-H3 as depicted in SEQ ID NO: 403, CDR-L1 as depicted in SEQ ID NO:

404, CDR-L2 as depicted in SEQ ID NO: 405 and CDR-L3 as depicted in SEQ ID NO: 406;
(l) CDR-H1 as depicted in SEQ ID NO: 411, CDR-H2 as depicted in SEQ ID NO: 412, CDR-H3 as depicted in SEQ ID NO: 413, CDR-L1 as depicted in SEQ ID NO: 414, CDR-L2 as depicted in SEQ ID NO: 415 and CDR-L3 as depicted in SEQ ID NO: 416;
(m) CDR-H1 as depicted in SEQ ID NO: 421, CDR-H2 as depicted in SEQ ID NO: 422, CDR-H3 as depicted in SEQ ID NO: 423, CDR-L1 as depicted in SEQ ID NO: 424, CDR-L2 as depicted in SEQ ID NO: 425 and CDR-L3 as depicted in SEQ ID NO: 426;
(n) CDR-H1 as depicted in SEQ ID NO: 431, CDR-H2 as depicted in SEQ ID NO: 432, CDR-H3 as depicted in SEQ ID NO: 433, CDR-L1 as depicted in SEQ ID NO: 434, CDR-L2 as depicted in SEQ ID NO: 435 and CDR-L3 as depicted in SEQ ID NO: 436;
(o) CDR-H1 as depicted in SEQ ID NO: 441, CDR-H2 as depicted in SEQ ID NO: 442, CDR-H3 as depicted in SEQ ID NO: 443, CDR-L1 as depicted in SEQ ID NO: 444, CDR-L2 as depicted in SEQ ID NO:445 and CDR-L3 as depicted in SEQ ID NO: 446;
(p) CDR-H1 as depicted in SEQ ID NO: 451, CDR-H2 as depicted in SEQ ID NO: 452, CDR-H3 as depicted in SEQ ID NO: 453, CDR-L1 as depicted in SEQ ID NO: 454, CDR-L2 as depicted in SEQ ID NO: 455 and CDR-L3 as depicted in SEQ ID NO: 456;
(q) CDR-H1 as depicted in SEQ ID NO: 461, CDR-H2 as depicted in SEQ ID NO: 462, CDR-H3 as depicted in SEQ ID NO: 463, CDR-L1 as depicted in SEQ ID NO: 464, CDR-L2 as depicted in SEQ ID NO: 465 and CDR-L3 as depicted in SEQ ID NO: 466;
(r) CDR-H1 as depicted in SEQ ID NO: 471, CDR-H2 as depicted in SEQ ID NO: 472, CDR-H3 as depicted in SEQ ID NO: 473, CDR-L1 as depicted in SEQ ID NO: 474, CDR-L2 as depicted in SEQ ID NO: 475 and CDR-L3 as depicted in SEQ ID NO: 476;
(s) CDR-H1 as depicted in SEQ ID NO: 481, CDR-H2 as depicted in SEQ ID NO: 482, CDR-H3 as depicted in SEQ ID NO: 483, CDR-L1 as depicted in SEQ ID NO: 484, CDR-L2 as depicted in SEQ ID NO: 485 and CDR-L3 as depicted in SEQ ID NO: 486;
(t) CDR-H1 as depicted in SEQ ID NO: 491, CDR-H2 as depicted in SEQ ID NO: 492, CDR-H3 as depicted in SEQ ID NO: 493, CDR-L1 as depicted in SEQ ID NO: 494, CDR-L2 as depicted in SEQ ID NO: 495 and CDR-L3 as depicted in SEQ ID NO: 496; and
(u) CDR-H1 as depicted in SEQ ID NO: 501, CDR-H2 as depicted in SEQ ID NO: 502, CDR-H3 as depicted in SEQ ID NO: 503, CDR-L1 as depicted in SEQ ID NO: 504, CDR-L2 as depicted in SEQ ID NO: 505 and CDR-L3 as depicted in SEQ ID NO: 506.

In yet another embodiment, the first binding domain of the binding molecule comprises a VH region selected from the group consisting of a VH region as depicted in SEQ ID NO: 237, SEQ ID NO: 247, SEQ ID NO: 257, SEQ ID NO: 267, SEQ ID NO: 277, SEQ ID NO: 287, SEQ ID NO: 297, SEQ ID NO: 307, SEQ ID NO: 397, SEQ ID NO: 407, SEQ ID NO: 417, SEQ ID NO: 427, SEQ ID NO: 437, SEQ ID NO: 447, SEQ ID NO: 457, SEQ ID NO: 467, SEQ ID NO: 477, SEQ ID NO: 487, SEQ ID NO: 497, and SEQ ID NO: 507.

In another embodiment, the first binding domain of the binding molecule comprises a VL region selected from the group consisting of a VL region as depicted in SEQ ID NO: 238, SEQ ID NO: 248, SEQ ID NO: 258, SEQ ID NO: 268, SEQ ID NO: 278, SEQ ID NO: 288, SEQ ID NO: 298, SEQ ID NO: 308, SEQ ID NO: 398, SEQ ID NO: 408, SEQ ID NO: 418, SEQ ID NO: 428, SEQ ID NO: 438, SEQ ID NO: 448, SEQ ID NO: 458, SEQ ID NO: 468, SEQ ID NO: 478, SEQ ID NO: 488, SEQ ID NO: 498, and SEQ ID NO: 508.

In one embodiment, the first binding domain of the binding molecule comprises a VH region and a VL region selected from the group consisting of:
(a) a VH region as depicted in SEQ ID NO: 237, and a VL region as depicted in SEQ ID NO: 238;
(b) a VH region as depicted in SEQ ID NO: 247, and a VL region as depicted in SEQ ID NO: 248;
(c) a VH region as depicted in SEQ ID NO: 257, and a VL region as depicted in SEQ ID NO: 258;
(d) a VH region as depicted in SEQ ID NO: 267, and a VL region as depicted in SEQ ID NO: 268;
(e) a VH region as depicted in SEQ ID NO: 277, and a VL region as depicted in SEQ ID NO: 278;
(f) a VH region as depicted in SEQ ID NO: 287, and a VL region as depicted in SEQ ID NO: 288;
(g) a VH region as depicted in SEQ ID NO: 297, and a VL region as depicted in SEQ ID NO: 298;
(h) a VH region as depicted in SEQ ID NO: 307, and a VL region as depicted in SEQ ID NO: 308;
(i) a VH region as depicted in SEQ ID NO: 397, and a VL region as depicted in SEQ ID NO: 398;
(k) a VH region as depicted in SEQ ID NO: 407, and a VL region as depicted in SEQ ID NO: 408;
(l) a VH region as depicted in SEQ ID NO: 417, and a VL region as depicted in SEQ ID NO: 418;
(m) a VH region as depicted in SEQ ID NO: 427, and a VL region as depicted in SEQ ID NO: 428;
(n) a VH region as depicted in SEQ ID NO: 437, and a VL region as depicted in SEQ ID NO: 438;
(o) a VH region as depicted in SEQ ID NO: 447, and a VL region as depicted in SEQ ID NO: 448;
(p) a VH region as depicted in SEQ ID NO: 457, and a VL region as depicted in SEQ ID NO: 458;
(q) a VH region as depicted in SEQ ID NO: 467, and a VL region as depicted in SEQ ID NO: 468;
(r) a VH region as depicted in SEQ ID NO: 477, and a VL region as depicted in SEQ ID NO: 478;
(s) a VH region as depicted in SEQ ID NO: 487, and a VL region as depicted in SEQ ID NO: 488;
(t) a VH region as depicted in SEQ ID NO: 497, and a VL region as depicted in SEQ ID NO: 498; and
(u) a VH region as depicted in SEQ ID NO: 507, and a VL region as depicted in SEQ ID NO: 508.

In one example, the first binding domain comprises an amino acid sequence selected from the group consisting of SEQ ID NO: 239, SEQ ID NO: 249, SEQ ID NO: 259, SEQ ID NO: 269, SEQ ID NO: 279, SEQ ID NO: 289, SEQ ID NO: 299, SEQ ID NO: 309, SEQ ID NO: 399, SEQ ID NO: 409, SEQ ID NO: 419, SEQ ID NO: 429, SEQ ID NO: 439, SEQ ID NO: 449, SEQ ID NO: 459, SEQ ID NO: 469, SEQ ID NO: 479, SEQ ID NO: 489, SEQ ID NO: 499, and SEQ ID NO: 509.

A preferred CDR-H1 is shown in the amino acid sequence DYYIN. A preferred CDR-H2 is shown in the amino acid sequence WIYFASGNSEYNQKFTG. A preferred CDR-H3 is shown in the amino acid sequence LYDYDWYFDV. A preferred CDR-L1 is shown in the amino acid sequence KSSQSLVHSNGNTYLH. A preferred CDR-L2 is shown in the amino acid sequence KVSNRFS. A preferred CDR-L2 is shown in the amino acid sequence AETSHVPWT or SQSSIYPWT.

Preferred is a binding molecule having the amino acid sequence shown in SEQ ID NO: 300. Also preferred is a binding molecule having the amino acid sequence shown in SEQ ID NO: 500.

Furthermore, the present invention relates to the use of epitope cluster 3 and 4 of BCMA, preferably human BCMA, for the generation of a binding molecule, preferably an antibody, which is capable of binding to BCMA, preferably human BCMA. The epitope cluster 3 and 4 of BCMA preferably corresponds to amino acid residues 24 to 41 and 42 to 54, respectively, of the sequence as depicted in SEQ ID NO: 1002.

In addition, the present invention provides a method for the generation of an antibody, preferably a bispecific binding molecule, which is capable of binding to BCMA, preferably human BCMA, comprising
(a) immunizing an animal with a polypeptide comprising epitope cluster 3 and 4 of BCMA, preferably human BCMA, wherein epitope cluster 3 and 4 of BCMA corresponds to amino acid residues 24 to 41 and 42 to 54 of the sequence as depicted in SEQ ID NO: 1002,
(b) obtaining said antibody, and
(c) optionally converting said antibody into a bispecific binding molecule which is capable of binding to human BCMA and preferably to the T cell CD3 receptor complex.

Preferably, step (b) includes that the obtained antibody is tested as follows: when the respective epitope cluster in the human BCMA protein is exchanged with the respective epitope cluster of a murine BCMA antigen (resulting in a construct comprising human BCMA, wherein human epitope cluster 3 and/or 4 is replaced with the respective murine epitope cluster), a decrease in the binding of the antibody will occur. Said decrease is preferably at least 10%, 20%, 30%, 40%, 50%; more preferably at least 60%, 70%, 80%, 90%, 95% or even 100% in comparison to the respective epitope cluster in the human BCMA protein, whereby binding to the respective epitope cluster 3 and 4 in the human BCMA protein is set to be 100%. It is envisaged that the aforementioned human BCMA/murine BCMA chimeras are expressed in CHO cells. It is also envisaged that at least one of the human BCMA/murine BCMA chimeras is fused with a transmembrane domain and/or cytoplasmic domain of a different membrane-bound protein such as EpCAM; see FIG. 2a. A method to test this loss of binding due to exchange with the respective epitope cluster of a non-human (e.g. murine) BCMA antigen is described in the appended Examples A, in particular in Examples A1-A3.

The method may further include testing as to whether the antibody binds to epitope cluster 3 and 4 of human BCMA and is further capable of binding to epitope cluster 3 and/or 4 of macaque BCMA such as BCMA from *Macaca mulatta* or *Macaca fascicularis* (SEQ ID NOs: 1017 and 121).

Second Group of Binding Molecules (B)

The second group of binding molecules relates to a bispecific binding molecule comprising a first and a second binding domain, wherein the first binding domain is capable of binding to the extracellular domain of human BCMA and to the extracellular domain of murine BCMA, and the second binding domain is capable of binding to the T cell CD3 receptor complex.

Thus, in a first aspect of the second group of the present invention provides a binding molecule which is at least bispecific comprising a first and a second binding domain, wherein
(a) the first binding domain is capable of binding to the extracellular domain of human BCMA and to the extracellular domain of murine BCMA; and
(b) the second binding domain is capable of binding to the T cell CD3 receptor complex; and
wherein the extracellular domain of human BCMA corresponds to the amino acid sequence as depicted in SEQ ID NO: 1007, and the extracellular domain of murine BCMA corresponds to the amino acid sequence as depicted in SEQ ID NO: 1008.

The first binding domain is capable of binding to the extracellular domain of human BCMA and to the extracellular domain of murine BCMA. The extracellular domain of human BCMA (amino acid sequence as depicted in SEQ ID NO: 1007) corresponds to amino acid residues 1-54 of the human BCMA full-length polypeptide which is depicted in SEQ ID NO: 1002. The extracellular domain of murine BCMA (amino acid sequence as depicted in SEQ ID NO: 1008) corresponds to amino acid residues 1-49 of the murine BCMA full-length polypeptide which is depicted in SEQ ID NO: 1004.

In one aspect, the first binding domain of the present invention further binds to macaque BCMA such as BCMA from *Macaca mulatta* (SEQ ID NO:1017) or *Macaca fascicularis* (SEQ ID NO:1017).

In one aspect of the present invention, the first binding domain of the binding molecule is additionally or alternatively capable of binding to *Callithrix jacchus, Saguinus oedipus* and/or *Saimiri sciureus* BCMA.

The affinity of the first binding domain for human BCMA is preferably ≤15 nM, more preferably ≤10 nM, even more preferably ≤5 nM, most preferably ≤1 nM.

In one embodiment, the first binding domain of the binding molecule of the invention comprises a VH region comprising CDR-H1, CDR-H2 and CDR-H3 and a VL region comprising CDR-L1, CDR-L2 and CDR-L3 selected from the group consisting of:
(a) CDR-H1 as depicted in SEQ ID NO: 81, CDR-H2 as depicted in SEQ ID NO: 82, CDR-H3 as depicted in SEQ ID NO: 83, CDR-L1 as depicted in SEQ ID NO: 84, CDR-L2 as depicted in SEQ ID NO: 85 and CDR-L3 as depicted in SEQ ID NO: 86;
(b) CDR-H1 as depicted in SEQ ID NO: 91, CDR-H2 as depicted in SEQ ID NO: 92, CDR-H3 as depicted in SEQ ID NO: 93, CDR-L1 as depicted in SEQ ID NO: 94, CDR-L2 as depicted in SEQ ID NO: 95 and CDR-L3 as depicted in SEQ ID NO: 96;
(c) CDR-H1 as depicted in SEQ ID NO: 101, CDR-H2 as depicted in SEQ ID NO: 102, CDR-H3 as depicted in SEQ ID NO: 103, CDR-L1 as depicted in SEQ ID NO: 104, CDR-L2 as depicted in SEQ ID NO: 105 and CDR-L3 as depicted in SEQ ID NO: 106;
(d) CDR-H1 as depicted in SEQ ID NO: 111, CDR-H2 as depicted in SEQ ID NO: 112, CDR-H3 as depicted in SEQ ID NO: 113, CDR-L1 as depicted in SEQ ID NO: 114, CDR-L2 as depicted in SEQ ID NO: 115 and CDR-L3 as depicted in SEQ ID NO: 116;
(e) CDR-H1 as depicted in SEQ ID NO: 121, CDR-H2 as depicted in SEQ ID NO: 122, CDR-H3 as depicted in SEQ ID NO: 123, CDR-L1 as depicted in SEQ ID NO: 124, CDR-L2 as depicted in SEQ ID NO: 125 and CDR-L3 as depicted in SEQ ID NO: 126;
(f) CDR-H1 as depicted in SEQ ID NO: 131, CDR-H2 as depicted in SEQ ID NO: 132, CDR-H3 as depicted in SEQ ID NO: 133, CDR-L1 as depicted in SEQ ID NO: 134, CDR-L2 as depicted in SEQ ID NO: 135 and CDR-L3 as depicted in SEQ ID NO: 136;
(g) CDR-H1 as depicted in SEQ ID NO: 141, CDR-H2 as depicted in SEQ ID NO: 142, CDR-H3 as depicted in SEQ ID NO: 143, CDR-L1 as depicted in SEQ ID NO:

144, CDR-L2 as depicted in SEQ ID NO: 145 and CDR-L3 as depicted in SEQ ID NO: 146; and
(h) CDR-H1 as depicted in SEQ ID NO: 151, CDR-H2 as depicted in SEQ ID NO: 152, CDR-H3 as depicted in SEQ ID NO: 153, CDR-L1 as depicted in SEQ ID NO: 154, CDR-L2 as depicted in SEQ ID NO: 155 and CDR-L3 as depicted in SEQ ID NO: 156.

In yet another embodiment, the first binding domain of the binding molecule comprises a VH region selected from the group consisting of a VH region as depicted in SEQ ID NO: 87, SEQ ID NO: 97, SEQ ID NO: 107, SEQ ID NO: 117, SEQ ID NO: 127, SEQ ID NO: 137, SEQ ID NO: 147 and SEQ ID NO: 157.

In another embodiment, the first binding domain of the binding molecule comprises a VL region selected from the group consisting of a VL region as depicted in SEQ ID NO: 88, SEQ ID NO: 98, SEQ ID NO: 108, SEQ ID NO: 118, SEQ ID NO: 128, SEQ ID NO: 138, SEQ ID NO: 148 and SEQ ID NO: 158.

In one embodiment, the first binding domain of the binding molecule comprises a VH region and a VL region selected from the group consisting of:
(a) a VH region as depicted in SEQ ID NO: 87, and a VL region as depicted in SEQ ID NO: 88;
(b) a VH region as depicted in SEQ ID NO: 97, and a VL region as depicted in SEQ ID NO: 98;
(c) a VH region as depicted in SEQ ID NO: 107, and a VL region as depicted in SEQ ID NO: 108;
(d) a VH region as depicted in SEQ ID NO: 117, and a VL region as depicted in SEQ ID NO: 118;
(e) a VH region as depicted in SEQ ID NO: 127, and a VL region as depicted in SEQ ID NO: 128;
(f) a VH region as depicted in SEQ ID NO: 137, and a VL region as depicted in SEQ ID NO: 138;
(g) a VH region as depicted in SEQ ID NO: 147, and a VL region as depicted in SEQ ID NO: 148; and
(h) a VH region as depicted in SEQ ID NO: 157, and a VL region as depicted in SEQ ID NO: 158.

In one example, the first binding domain comprises an amino acid sequence selected from the group consisting of SEQ ID NO: 89, SEQ ID NO: 99, SEQ ID NO: 109, SEQ ID NO: 119, SEQ ID NO: 129, SEQ ID NO: 139, SEQ ID NO: 149 and SEQ ID NO: 159.

The second group of binding molecules also relates to the following items:
1. A binding molecule comprising a first and a second binding domain, wherein
   (a) the first binding domain is capable of binding to the extracellular domain of human BCMA and to the extracellular domain of murine BCMA; and
   (b) the second binding domain is capable of binding to the T cell CD3 receptor complex; and
   wherein the extracellular domain of human BCMA corresponds to the amino acid sequence as depicted in SEQ ID NO: 1007, and the extracellular domain of murine BCMA corresponds to the amino acid sequence as depicted in SEQ ID NO: 1008.
2. The binding molecule according to item 1, wherein the first binding domain is furthermore capable of binding to macaque BCMA.
3. The binding molecule according to item 1 or 2, wherein the second binding domain is capable of binding to CD3 epsilon, preferably human CD3 epsilon.
4. The binding molecule according to any one of items 1 to 3, wherein the first and/or the second binding domain are derived from an antibody.
5. The binding molecule according to item 4, which is selected from the group consisting of (scFv)$_2$, (single domain mAb)$_2$, scFv-single domain mAb, diabodies and oligomers thereof.
6. The binding molecule according to any one of the preceding items, wherein the first binding domain comprises a VH region comprising CDR-H1, CDR-H2 and CDR-H3 and a VL region comprising CDR-L1, CDR-L2 and CDR-L3 selected from the group consisting of:
   (a) CDR-H1 as depicted in SEQ ID NO: 81, CDR-H2 as depicted in SEQ ID NO: 82, CDR-H3 as depicted in SEQ ID NO: 83, CDR-L1 as depicted in SEQ ID NO: 84, CDR-L2 as depicted in SEQ ID NO: 85 and CDR-L3 as depicted in SEQ ID NO: 86;
   (b) CDR-H1 as depicted in SEQ ID NO: 91, CDR-H2 as depicted in SEQ ID NO: 92, CDR-H3 as depicted in SEQ ID NO: 93, CDR-L1 as depicted in SEQ ID NO: 94, CDR-L2 as depicted in SEQ ID NO: 95 and CDR-L3 as depicted in SEQ ID NO: 96;
   (c) CDR-H1 as depicted in SEQ ID NO: 101, CDR-H2 as depicted in SEQ ID NO: 102, CDR-H3 as depicted in SEQ ID NO: 103, CDR-L1 as depicted in SEQ ID NO: 104, CDR-L2 as depicted in SEQ ID NO: 105 and CDR-L3 as depicted in SEQ ID NO: 106;
   (d) CDR-H1 as depicted in SEQ ID NO: 111, CDR-H2 as depicted in SEQ ID NO: 112, CDR-H3 as depicted in SEQ ID NO: 113, CDR-L1 as depicted in SEQ ID NO: 114, CDR-L2 as depicted in SEQ ID NO: 115 and CDR-L3 as depicted in SEQ ID NO: 116;
   (e) CDR-H1 as depicted in SEQ ID NO: 121, CDR-H2 as depicted in SEQ ID NO: 122, CDR-H3 as depicted in SEQ ID NO: 123, CDR-L1 as depicted in SEQ ID NO: 124, CDR-L2 as depicted in SEQ ID NO: 125 and CDR-L3 as depicted in SEQ ID NO: 126;
   (f) CDR-H1 as depicted in SEQ ID NO: 131, CDR-H2 as depicted in SEQ ID NO: 132, CDR-H3 as depicted in SEQ ID NO: 133, CDR-L1 as depicted in SEQ ID NO: 134, CDR-L2 as depicted in SEQ ID NO: 135 and CDR-L3 as depicted in SEQ ID NO: 136;
   (g) CDR-H1 as depicted in SEQ ID NO: 141, CDR-H2 as depicted in SEQ ID NO: 142, CDR-H3 as depicted in SEQ ID NO: 143, CDR-L1 as depicted in SEQ ID NO: 144, CDR-L2 as depicted in SEQ ID NO: 145 and CDR-L3 as depicted in SEQ ID NO: 146; and
   (h) CDR-H1 as depicted in SEQ ID NO: 151, CDR-H2 as depicted in SEQ ID NO: 152, CDR-H3 as depicted in SEQ ID NO: 153, CDR-L1 as depicted in SEQ ID NO: 154, CDR-L2 as depicted in SEQ ID NO: 155 and CDR-L3 as depicted in SEQ ID NO: 156.
7. The binding molecule according to any one of the preceding items, wherein the first binding domain comprises a VH region selected from the group consisting of VH regions as depicted in SEQ ID NO: 87, SEQ ID NO: 97, SEQ ID NO: 107, SEQ ID NO: 117, SEQ ID NO: 127, SEQ ID NO: 137, SEQ ID NO: 147 and SEQ ID NO: 157.
8. The binding molecule according to any one of the preceding items, wherein the first binding domain comprises a VL region selected from the group consisting of VL regions as depicted in SEQ ID NO: 88, SEQ ID NO: 98, SEQ ID NO: 108, SEQ ID NO: 118, SEQ ID NO: 128, SEQ ID NO: 138, SEQ ID NO: 148 and SEQ ID NO: 158.
9. The binding molecule according to any one of the preceding items, wherein the first binding domain comprises a VH region and a VL region selected from the group consisting of:
   (a) a VH region as depicted in SEQ ID NO: 87, and a VL region as depicted in SEQ ID NO: 88;

(b) a VH region as depicted in SEQ ID NO: 97, and a VL region as depicted in SEQ ID NO: 98;
(c) a VH region as depicted in SEQ ID NO: 107, and a VL region as depicted in SEQ ID NO: 108;
(d) a VH region as depicted in SEQ ID NO: 117, and a VL region as depicted in SEQ ID NO: 118;
(e) a VH region as depicted in SEQ ID NO: 127, and a VL region as depicted in SEQ ID NO: 128;
(f) a VH region as depicted in SEQ ID NO: 137, and a VL region as depicted in SEQ ID NO: 138;
(g) a VH region as depicted in SEQ ID NO: 147, and a VL region as depicted in SEQ ID NO: 148; and
(h) a VH region as depicted in SEQ ID NO: 157, and a VL region as depicted in SEQ ID NO: 158.

10. The binding molecule according to item 9, wherein the first binding domain comprises an amino acid sequence selected from the group consisting of SEQ ID NO: 89, SEQ ID NO: 99, SEQ ID NO: 109, SEQ ID NO: 119, SEQ ID NO: 129, SEQ ID NO: 139, SEQ ID NO: 149 and SEQ ID NO: 159.

11. A nucleic acid sequence encoding a binding molecule as defined in any one of items 1 to 10.

12. A vector comprising a nucleic acid sequence as defined in item 11.

13. A host cell transformed or transfected with the nucleic acid sequence as defined in item 11 or with the vector as defined in item 12.

14. A process for the production of a binding molecule according to any one of items 1 to 10, said process comprising culturing a host cell as defined in item 13 under conditions allowing the expression of the binding molecule as defined in any one of items 1 to 10 and recovering the produced binding molecule from the culture.

15. A pharmaceutical composition comprising a binding molecule according to any one of items 1 to 10, or produced according to the process of item 14.

16. The binding molecule according to any one of items 1 to 10, or produced according to the process of item 14 for use in the prevention, treatment or amelioration of a disease selected from the group consisting of plasma cell disorders, other B cell disorders that correlate with BCMA expression and autoimmune diseases.

17. A method for the treatment or amelioration of a disease selected from the group consisting of plasma cell disorders, other B cell disorders that correlate with BCMA expression and autoimmune diseases, comprising the step of administering to a subject in need thereof the binding molecule according to any one of items 1 to 10, or produced according to the process of item 14.

18. The method according to item 17, wherein the plasma cell disorder is selected from the group consisting of multiple myeloma, plasmacytoma, plasma cell leukemia, macroglobulinemia, amyloidosis, Waldenstrom's macroglobulinemia, solitary bone plasmacytoma, extramedullary plasmacytoma, osteosclerotic myeloma, heavy chain diseases, monoclonal gammopathy of undetermined significance, and smoldering multiple myeloma.

19. The method according to item 17, wherein the autoimmune disease is systemic lupus erythematodes or rheumatoid arthritis.

20. A kit comprising a binding molecule as defined in any one of items 1 to 10, a nucleic acid molecule as defined in item 11, a vector as defined in item 12, or a host cell as defined in item 13.

Third Group of Binding Molecules (C)

The third group of binding molecules of the present invention relates to a binding molecule which is at least bispecific comprising a first and a second binding domain, wherein the first binding domain is capable of binding to epitope cluster 1 and 4 of BCMA, and the second binding domain is capable of binding to the T cell CD3 receptor complex.

Thus, in a first aspect the present invention provides a binding molecule which is at least bispecific comprising a first and a second binding domain, wherein
(a) the first binding domain is capable of binding to epitope cluster 1 (MLQMAGQ) (SEQ ID NO: 1018) and 4(NASVTNSVKGTNA) (SEQ ID NO: 1019) of BCMA; and
(b) the second binding domain is capable of binding to the T cell CD3 receptor complex; and
wherein epitope cluster 1 of BCMA corresponds to amino acid residues 1 to 7 of the sequence as depicted in SEQ ID NO: 1002, and epitope cluster 4 of BCMA corresponds to amino acid residues 42 to 54 of the sequence as depicted in SEQ ID NO: 1002.

It is also envisaged that the first binding domain of the present invention is able to bind concomitantly to epitope cluster 1 and 4 of human BCMA In one aspect, the first binding domain of the present invention is capable of binding to epitope cluster 1 and 4 of human BCMA, preferably human BCMA ECD. Accordingly, when the respective epitope cluster in the human BCMA protein is exchanged with the respective epitope cluster of a murine BCMA antigen (resulting in a construct comprising human BCMA, wherein human epitope cluster 1 and/or 4 is replaced with the respective murine epitope cluster; see exemplarily SEQ ID NO: 1009 and 1012, respectively), a decrease in the binding of the binding domain will occur. Said decrease is preferably at least 10%, 20%, 30%, 40%, 50%; more preferably at least 60%, 70%, 80%, 90%, 95% or even 100% in comparison to the respective epitope cluster in the human BCMA protein, whereby binding to the respective epitope cluster in the human BCMA protein is set to be 100%. It is envisaged that the aforementioned human BCMA/murine BCMA chimeras are expressed in CHO cells. It is also envisaged that at least one of the human BCMA/murine BCMA chimeras, preferably the murine E1/human BCMA chimera is fused with a transmembrane domain and/or cytoplasmic domain of a different membrane-bound protein such as EpCAM; see FIG. 2a. A method to test this loss of binding due to exchange with the respective epitope cluster of a non-human (e.g. murine) BCMA antigen is described in the appended Examples, in particular in Examples C1-3.

In one aspect, the first binding domain of the present invention binds to epitope cluster 1 and 4 of human BCMA and is further capable of binding to epitope cluster 1 and/or 4 of macaque BCMA (SEQ ID NO:1020 and 1021, respectively) such as from *Macaca mulatta* or *Macaca fascicularis*. It is envisaged that the first binding domain does not bind to murine BCMA.

Accordingly, in one embodiment, a binding domain which binds to human BCMA, in particular to epitope cluster 1 and 4 of the extracellular protein domain of BCMA formed by amino acid residues 1 to 7 and 42 to 54, respectively, of the human sequence as depicted in SEQ ID NO: 1002, also binds to macaque BCMA, in particular to epitope cluster 1 and/or 4 of the extracellular protein domain of BCMA formed by amino acid residues 1 to 7 and 41 to 53, respectively, of the macaque BCMA sequence as depicted in SEQ ID NO: 1006.

In one embodiment, a first binding domain of a binding molecule is capable of binding to epitope cluster 1 and 4 of BCMA, wherein epitope cluster 1 and 4 of BCMA corresponds to amino acid residues 1 to 7 and 42 to 54, respectively, of the sequence as depicted in SEQ ID NO: 1002

(human BCMA full-length polypeptide) or SEQ ID NO: 1007 (human BCMA extracellular domain: amino acids 1-54 of SEQ ID NO: 1002).

In one aspect of the present invention, the first binding domain of the binding molecule is additionally or alternatively capable of binding to epitope cluster 1 and/or 4 of *Caffithrix jacchus, Saguinus oedipus* and/or *Saimiri sciureus* BCMA.

The affinity of the first binding domain for human BCMA is preferably 5 nM, more preferably ≤10 nM, even more preferably ≤5 nM, most preferably ≤1 nM.

In one embodiment, the first binding domain of the binding molecule of the invention comprises a VH region comprising CDR-H1, CDR-H2 and CDR-H3 and a VL region comprising CDR-L1, CDR-L2 and CDR-L3 selected from the group consisting of:
  (a) CDR-H1 as depicted in SEQ ID NO: 511, CDR-H2 as depicted in SEQ ID NO: 512, CDR-H3 as depicted in SEQ ID NO: 513, CDR-L1 as depicted in SEQ ID NO: 514, CDR-L2 as depicted in SEQ ID NO: 515 and CDR-L3 as depicted in SEQ ID NO: 516;
  (b) CDR-H1 as depicted in SEQ ID NO: 521, CDR-H2 as depicted in SEQ ID NO: 522, CDR-H3 as depicted in SEQ ID NO: 523, CDR-L1 as depicted in SEQ ID NO: 524, CDR-L2 as depicted in SEQ ID NO: 525 and CDR-L3 as depicted in SEQ ID NO: 526;
  (c) CDR-H1 as depicted in SEQ ID NO: 531, CDR-H2 as depicted in SEQ ID NO: 532, CDR-H3 as depicted in SEQ ID NO: 533, CDR-L1 as depicted in SEQ ID NO: 534, CDR-L2 as depicted in SEQ ID NO: 535 and CDR-L3 as depicted in SEQ ID NO: 536;
  (d) CDR-H1 as depicted in SEQ ID NO: 541, CDR-H2 as depicted in SEQ ID NO: 542, CDR-H3 as depicted in SEQ ID NO: 543, CDR-L1 as depicted in SEQ ID NO: 544, CDR-L2 as depicted in SEQ ID NO: 545 and CDR-L3 as depicted in SEQ ID NO: 546;
  (e) CDR-H1 as depicted in SEQ ID NO: 551, CDR-H2 as depicted in SEQ ID NO: 552, CDR-H3 as depicted in SEQ ID NO: 553, CDR-L1 as depicted in SEQ ID NO: 554, CDR-L2 as depicted in SEQ ID NO: 555 and CDR-L3 as depicted in SEQ ID NO: 556;
  (f) CDR-H1 as depicted in SEQ ID NO: 561, CDR-H2 as depicted in SEQ ID NO: 562, CDR-H3 as depicted in SEQ ID NO: 563, CDR-L1 as depicted in SEQ ID NO: 564, CDR-L2 as depicted in SEQ ID NO: 565 and CDR-L3 as depicted in SEQ ID NO: 566; and
  (g) CDR-H1 as depicted in SEQ ID NO: 571, CDR-H2 as depicted in SEQ ID NO: 572, CDR-H3 as depicted in SEQ ID NO: 573, CDR-L1 as depicted in SEQ ID NO: 574, CDR-L2 as depicted in SEQ ID NO: 575 and CDR-L3 as depicted in SEQ ID NO: 576.

In yet another embodiment, the first binding domain of the binding molecule comprises a VH region selected from the group consisting of a VH region as depicted in SEQ ID NO: 517, SEQ ID NO: 527, SEQ ID NO: 537, SEQ ID NO: 547, SEQ ID NO: 557, SEQ ID NO: 567, and SEQ ID NO: 577.

In another embodiment, the first binding domain of the binding molecule comprises a VL region selected from the group consisting of a VL region as depicted in SEQ ID NO: 518, SEQ ID NO: 528, SEQ ID NO: 538, SEQ ID NO: 548, SEQ ID NO: 558, SEQ ID NO: 568, and SEQ ID NO: 578.

In one embodiment, the first binding domain of the binding molecule comprises a VH region and a VL region selected from the group consisting of:
  (a) a VH region as depicted in SEQ ID NO: 517, and a VL region as depicted in SEQ ID NO: 518;
  (b) a VH region as depicted in SEQ ID NO: 527, and a VL region as depicted in SEQ ID NO: 528;
  (c) a VH region as depicted in SEQ ID NO: 537, and a VL region as depicted in SEQ ID NO: 538;
  (d) a VH region as depicted in SEQ ID NO: 547, and a VL region as depicted in SEQ ID NO: 548;
  (e) a VH region as depicted in SEQ ID NO: 557, and a VL region as depicted in SEQ ID NO: 558;
  (f) a VH region as depicted in SEQ ID NO: 567, and a VL region as depicted in SEQ ID NO: 568; and
  (g) a VH region as depicted in SEQ ID NO: 577, and a VL region as depicted in SEQ ID NO: 578.

In one example, the first binding domain comprises an amino acid sequence selected from the group consisting of SEQ ID NO: 519, SEQ ID NO: 529, SEQ ID NO: 539, SEQ ID NO: 549, SEQ ID NO: 559, SEQ ID NO: 569, and SEQ ID NO: 579.

Furthermore, the present invention relates to the use of epitope cluster 1 and 4 of BCMA, preferably human BCMA, for the generation of a binding molecule, preferably an antibody, which is capable of binding to BCMA, preferably human BCMA. The epitope cluster 1 and 4 of BCMA preferably corresponds to amino acid residues 1 to 7 and 42 to 54, respectively, of the sequence as depicted in SEQ ID NO: 1002.

In addition, the present invention provides a method for the generation of an antibody, preferably a bispecific binding molecule, which is capable of binding to BCMA, preferably human BCMA, comprising
(a) immunizing an animal with a polypeptide comprising epitope cluster 1 and 4 of BCMA, preferably human BCMA, wherein epitope cluster 1 and 4 of BCMA corresponds to amino acid residues 1 to 7 and 42 to 54 of the sequence as depicted in SEQ ID NO: 1002,
(b) obtaining said antibody, and
(c) optionally converting said antibody into a bispecific binding molecule which is capable of binding to human BCMA and preferably to the T cell CD3 receptor complex.

Preferably, step (b) includes that the obtained antibody is tested as follows:
when the respective epitope cluster in the human BCMA protein is exchanged with the respective epitope cluster of a murine BCMA antigen (resulting in a construct comprising human BCMA, wherein human epitope cluster 1 and/or 4 is replaced with the respective murine epitope cluster, a decrease in the binding of the antibody will occur. Said decrease is preferably at least 10%, 20%, 30%, 40%, 50%; more preferably at least 60%, 70%, 80%, 90%, 95% or even 100% in comparison to the respective epitope cluster in the human BCMA protein, whereby binding to the respective epitope cluster 1 and 4 in the human BCMA protein is set to be 100%.

The method may further include testing as to whether the antibody binds to epitope cluster 1 and 4 of human BCMA and is further capable of binding to epitope cluster 1 and/or 4 of macaque BCMA.

The third group of binding molecules also relates to the following items:
1. A binding molecule which is at least bispecific comprising a first and a second binding domain, wherein
  (a) the first binding domain is capable of binding to epitope cluster 1 (MLQMAGQ) and 4(NASVTNSVKGTNA) of BCMA; and
  (b) the second binding domain is capable of binding to the T cell CD3 receptor complex; and
  wherein epitope cluster 1 of BCMA corresponds to amino acid residues 1 to 7 of the sequence as depicted in SEQ ID NO: 1002, and epitope cluster 4 of BCMA corresponds to amino acid residues 42 to 54 of the sequence as depicted in SEQ ID NO: 1002.
2. The binding molecule according to item 1, wherein the first binding domain is further capable of binding to epitope cluster 1 (MLQMARQ) and 4 (NASMTNSVKGMNA) of macaque BCMA.
3. The binding molecule according to item 1 or 2, wherein the second binding domain is capable of binding to CD3 epsilon.
4. The binding molecule according to any one of the preceding items, wherein the second binding domain is capable of binding to human CD3 and to macaque CD3.
5. The binding molecule according to any one of the preceding items, wherein the first and/or the second binding domain are derived from an antibody.
6. The binding molecule according to item 5, which is selected from the group consisting of (scFv)$_2$, (single domain mAb)$_2$, scFv-single domain mAb, diabodies and oligomers thereof.
7. The binding molecule according to any one of the preceding items, wherein the first binding domain comprises a VH region comprising CDR-H1, CDR-H2 and CDR-H3 and a VL region comprising CDR-L1, CDR-L2 and CDR-L3 selected from the group consisting of:
 (a) CDR-H1 as depicted in SEQ ID NO: 511, CDR-H2 as depicted in SEQ ID NO: 512, CDR-H3 as depicted in SEQ ID NO: 513, CDR-L1 as depicted in SEQ ID NO: 514, CDR-L2 as depicted in SEQ ID NO: 515 and CDR-L3 as depicted in SEQ ID NO: 516;
 (b) CDR-H1 as depicted in SEQ ID NO: 521, CDR-H2 as depicted in SEQ ID NO: 522, CDR-H3 as depicted in SEQ ID NO: 523, CDR-L1 as depicted in SEQ ID NO: 524, CDR-L2 as depicted in SEQ ID NO: 525 and CDR-L3 as depicted in SEQ ID NO: 526;
 (c) CDR-H1 as depicted in SEQ ID NO: 531, CDR-H2 as depicted in SEQ ID NO: 532, CDR-H3 as depicted in SEQ ID NO: 533, CDR-L1 as depicted in SEQ ID NO: 534, CDR-L2 as depicted in SEQ ID NO: 535 and CDR-L3 as depicted in SEQ ID NO: 536;
 (d) CDR-H1 as depicted in SEQ ID NO: 541, CDR-H2 as depicted in SEQ ID NO: 542, CDR-H3 as depicted in SEQ ID NO: 543, CDR-L1 as depicted in SEQ ID NO: 544, CDR-L2 as depicted in SEQ ID NO: 545 and CDR-L3 as depicted in SEQ ID NO: 546;
 (e) CDR-H1 as depicted in SEQ ID NO: 551, CDR-H2 as depicted in SEQ ID NO: 552, CDR-H3 as depicted in SEQ ID NO: 553, CDR-L1 as depicted in SEQ ID NO: 554, CDR-L2 as depicted in SEQ ID NO: 555 and CDR-L3 as depicted in SEQ ID NO: 556;
 (f) CDR-H1 as depicted in SEQ ID NO: 561, CDR-H2 as depicted in SEQ ID NO: 562, CDR-H3 as depicted in SEQ ID NO: 563, CDR-L1 as depicted in SEQ ID NO: 564, CDR-L2 as depicted in SEQ ID NO: 565 and CDR-L3 as depicted in SEQ ID NO: 566; and
 (g) CDR-H1 as depicted in SEQ ID NO: 571, CDR-H2 as depicted in SEQ ID NO: 572, CDR-H3 as depicted in SEQ ID NO: 573, CDR-L1 as depicted in SEQ ID NO: 574, CDR-L2 as depicted in SEQ ID NO: 575 and CDR-L3 as depicted in SEQ ID NO: 576.
8. The binding molecule according to any one of the preceding items, wherein the first binding domain comprises a VH region selected from the group consisting of VH regions as depicted in SEQ ID NO: 517, SEQ ID NO: 527, SEQ ID NO: 537, SEQ ID NO: 547, SEQ ID NO: 557, SEQ ID NO: 567, and SEQ ID NO: 577.
9. The binding molecule according to any one of the preceding items, wherein the first binding domain comprises a VL region selected from the group consisting of VL regions as depicted in SEQ ID NO: 518, SEQ ID NO: 528, SEQ ID NO: 538, SEQ ID NO: 548, SEQ ID NO: 558, SEQ ID NO: 568, and SEQ ID NO: 578.
10. The binding molecule according to any one of the preceding items, wherein the first binding domain comprises a VH region and a VL region selected from the group consisting of:
 (a) a VH region as depicted in SEQ ID NO: 517, and a VL region as depicted in SEQ ID NO: 518;
 (b) a VH region as depicted in SEQ ID NO: 527, and a VL region as depicted in SEQ ID NO: 528;
 (c) a VH region as depicted in SEQ ID NO: 537, and a VL region as depicted in SEQ ID NO: 538;
 (d) a VH region as depicted in SEQ ID NO: 547, and a VL region as depicted in SEQ ID NO: 548;
 (e) a VH region as depicted in SEQ ID NO: 557, and a VL region as depicted in SEQ ID NO: 558;
 (f) a VH region as depicted in SEQ ID NO: 567, and a VL region as depicted in SEQ ID NO: 568; and
 (g) a VH region as depicted in SEQ ID NO: 577, and a VL region as depicted in SEQ ID NO: 578.
11. The binding molecule according to item 10, wherein the first binding domain comprises an amino acid sequence selected from the group consisting of SEQ ID NO: 519, SEQ ID NO: 529, SEQ ID NO: 539, SEQ ID NO: 549, SEQ ID NO: 559, SEQ ID NO: 569, and SEQ ID NO: 579.
12. A nucleic acid sequence encoding a binding molecule as defined in any one of items 1 to 11.
13. A vector comprising a nucleic acid sequence as defined in item 12.
14. A host cell transformed or transfected with the nucleic acid sequence as defined in item 12 or with the vector as defined in item 13.
15. A process for the production of a binding molecule according to any one of items 1 to 11, said process comprising culturing a host cell as defined in item 14 under conditions allowing the expression of the binding molecule as defined in any one of items 1 to 11 and recovering the produced binding molecule from the culture.
16. A pharmaceutical composition comprising a binding molecule according to any one of items 1 to 11, or produced according to the process of item 15.
17. The binding molecule according to any one of items 1 to 11, or produced according to the process of item 15 for use in the prevention, treatment or amelioration of a disease selected from the group consisting of plasma cell disorders, other B cell disorders that correlate with BCMA expression and autoimmune diseases.
18. A method for the treatment or amelioration of a disease selected from the group consisting of plasma cell disorders, other B cell disorders that correlate with BCMA expression and autoimmune diseases, comprising the step of administering to a subject in need thereof the binding molecule according to any one of items 1 to 11, or produced according to the process of item 15.
19. The method according to item 18, wherein the plasma cell disorder is selected from the group consisting of multiple myeloma, plasmacytoma, plasma cell leukemia, macroglobulinemia, amyloidosis, Waldenstrom's macroglobulinemia, solitary bone plasmacytoma, extramedullary plasmacytoma, osteosclerotic myeloma, heavy chain diseases, monoclonal gammopathy of undetermined significance, and smoldering multiple myeloma.

20. The method according to item 18, wherein the autoimmune disease is systemic lupus erythematodes.
21. A kit comprising a binding molecule as defined in any one of items 1 to 11, a nucleic acid molecule as defined in item 12, a vector as defined in item 13, and/or a host cell as defined in item 14.
22. Use of epitope cluster 1 and of epitope cluster 4 of BCMA for the generation of a binding molecule, preferably an antibody, which is capable of binding to BCMA, wherein epitope cluster 1 of BCMA corresponds to amino acid residues 1 to 7 of the sequence as depicted in SEQ ID NO: 1002, and epitope cluster 4 of BCMA corresponds to amino acid residues 42 to 54 of the sequence as depicted in SEQ ID NO: 1002.
23. A method for the generation of an antibody, preferably a bispecific binding molecule, which is capable of binding to BCMA, comprising
    (a) immunizing an animal with a polypeptide comprising epitope cluster 1 and epitope cluster 4 of BCMA, wherein epitope cluster 1 of BCMA corresponds to amino acid residues 1 to 7 of the sequence as depicted in SEQ ID NO: 1002, and epitope cluster 4 of BCMA corresponds to amino acid residues 42 to 54 of the sequence as depicted in SEQ ID NO: 1002,
    (b) obtaining said antibody, and
    (c) optionally converting said antibody into a bispecific binding molecule which is capable of binding to human BCMA and preferably to the T cell CD3 receptor complex.

Fourth Group of Binding Molecules (D)

The fourth group of binding molecules of the present invention relates to a binding molecule comprising at least a first and a second binding domain which is bispecific, wherein the first binding domain is capable of binding to the extracellular domain of human BCMA and to at least one chimeric extracellular domain of BCMA which is generated by exchanging an epitope cluster or amino acid of the human BCMA antigen with the respective epitope cluster or amino acid of a non-human BCMA antigen; and the second binding domain is capable of binding to the T cell CD3 receptor complex.

Thus, in a first aspect the present invention provides a binding molecule which is at least bispecific comprising a first and a second binding domain, wherein
(a) the first binding domain is capable of binding to
    (i) the extracellular domain of human BCMA corresponding to the amino acid sequence as depicted in SEQ ID NO: 1007, and
    (ii) at least one of the chimeric extracellular domains of BCMA selected from the group consisting of BCMA domains corresponding to the amino acid sequences as depicted in SEQ ID NO: 1009, SEQ ID NO: 1010, SEQ ID NO: 1011, SEQ ID NO: 1012, SEQ ID NO: 1013, SEQ ID NO: 1014 and SEQ ID NO: 1015; and
(b) the second binding domain is capable of binding to the T cell CD3 receptor complex.

In a preferred embodiment, said first binding domain as defined in (a)(ii), herein, is capable of at least binding to the chimeric extracellular domains of BCMA as depicted in SEQ ID NO: 1011. In another embodiment according to the invention, the first binding domain is capable of binding to two, three, four, five, six or all of the chimeric extracellular domains of BCMA as depicted in SEQ ID NO: 1009, SEQ ID NO: 1010, SEQ ID NO: 1011, SEQ ID NO: 1012, SEQ ID NO: 1013, SEQ ID NO: 1014 and SEQ ID NO: 1015. In the context of this embodiment, the binding to the chimeric extracellular domain of BCMA as depicted in SEQ ID NO: 1011 in combination with one or more of the other chimeric extracellular domains is preferred.

In one aspect, the first binding domain of the present invention is capable of binding to epitope cluster 1 to 7 of human BCMA, preferably human BCMA ECD. For example, when the respective epitope cluster in the human BCMA protein is exchanged with the respective epitope cluster of a murine BCMA antigen (e.g., resulting in a construct comprising human BCMA, wherein, for example, human epitope cluster 1 and/or 4 is replaced with the respective murine epitope cluster; see exemplarily SEQ ID NO: 1009 and 1012, respectively), the binding domain is still capable of binding.

It is envisaged that the first binding domain is capable of binding to a chimeric BCMA construct comprising one or more of the aforementioned murine epitope clusters in a human BCMA ECD in each possible combination. For example, when the respective epitope cluster in the human BCMA protein is exchanged with the respective epitope cluster of a murine BCMA antigen (e.g., resulting in a construct comprising human BCMA, wherein, for example, human epitope cluster 3 is replaced with the respective murine epitope cluster; see exemplarily SEQ ID NO: 1011), the binding domain is still capable of binding. When more than one epitope cluster in the human BCMA ECD is replaced by the respective murine epitope cluster, it is preferred that at least one epitope cluster in the chimera is still from human BCMA ECD, preferably at least one, two, three or four epitope cluster(s) selected from epitope clusters 1, 2, 3 and 4 is(are) from human BCMA ECD.

It is envisaged that the aforementioned human BCMA/murine BCMA chimeras are expressed in CHO cells. It is also envisaged that at least one of the human BCMA/murine BCMA chimeras, for example, the murine E1/human BCMA chimera is fused with a transmembrane domain and/or cytoplasmic domain of a different membrane-bound protein such as EpCAM; see FIG. 2a.

A method to test the binding due to exchange with the respective epitope cluster of a non-human (e.g. murine) BCMA antigen is described in the appended Examples, in particular in Examples D1-3.

In one aspect, it is preferred that the first binding domain of the binding molecule according to the invention is not capable of binding to the extracellular domain of murine BCMA corresponding to the amino acid sequence as depicted in SEQ ID NO: 1008.

The term "is not capable of binding" means that the first binding domain of the binding molecule of the present invention does not bind to murine BCMA (SEQ ID NO: 1008), i.e., does not show reactivity of more than 30%, preferably more than 20%, more preferably more than 10%, particularly preferably more than 9%, 8%, 7%, 6% or 5%, preferably under the conditions applied in the appended Examples, with murine BCMA.

Specific binding is believed to be effected by specific motifs in the amino acid sequence of the binding domain and the antigen. Thus, binding is achieved as a result of their primary, secondary and/or tertiary structure as well as the result of secondary modifications of said structures. The specific interaction of the antigen-interaction-site with its specific antigen may result in a simple binding of said site to the antigen. Moreover, the specific interaction of the antigen-interaction-site with its specific antigen may alternatively or additionally result in the initiation of a signal, e.g. due to the induction of a change of the conformation of the antigen, an oligomerization of the antigen, etc.

In one aspect, the first binding domain of the invention is further capable of binding to macaque BCMA (SEQ ID NO:1020 and 1021, respectively) such as from *Macaca mulatta* or *Macaca fascicularis*. It is also envisaged that the first binding domain does not bind to murine BCMA.

The affinity of the first binding domain for human BCMA is preferably 5 nM, more preferably ≤10 nM, even more preferably ≤5 nM, most preferably ≤1 nM.

In one embodiment, the first binding domain of the binding molecule of the invention comprises a VH region comprising CDR-H1, CDR-H2 and CDR-H3 and a VL region comprising CDR-L1, CDR-L2 and CDR-L3 selected from the group consisting of:
- (a) CDR-H1 as depicted in SEQ ID NO: 841, CDR-H2 as depicted in SEQ ID NO: 842, CDR-H3 as depicted in SEQ ID NO: 843, CDR-L1 as depicted in SEQ ID NO: 844, CDR-L2 as depicted in SEQ ID NO: 845 and CDR-L3 as depicted in SEQ ID NO: 846;
- (b) CDR-H1 as depicted in SEQ ID NO: 851, CDR-H2 as depicted in SEQ ID NO: 852, CDR-H3 as depicted in SEQ ID NO: 853, CDR-L1 as depicted in SEQ ID NO: 854, CDR-L2 as depicted in SEQ ID NO: 855 and CDR-L3 as depicted in SEQ ID NO: 856;
- (c) CDR-H1 as depicted in SEQ ID NO: 861, CDR-H2 as depicted in SEQ ID NO: 862, CDR-H3 as depicted in SEQ ID NO: 863, CDR-L1 as depicted in SEQ ID NO: 864, CDR-L2 as depicted in SEQ ID NO: 865 and CDR-L3 as depicted in SEQ ID NO: 866;
- (d) CDR-H1 as depicted in SEQ ID NO: 871, CDR-H2 as depicted in SEQ ID NO: 872, CDR-H3 as depicted in SEQ ID NO: 873, CDR-L1 as depicted in SEQ ID NO: 874, CDR-L2 as depicted in SEQ ID NO: 875 and CDR-L3 as depicted in SEQ ID NO: 876;
- (e) CDR-H1 as depicted in SEQ ID NO: 881, CDR-H2 as depicted in SEQ ID NO: 882, CDR-H3 as depicted in SEQ ID NO: 883, CDR-L1 as depicted in SEQ ID NO: 884, CDR-L2 as depicted in SEQ ID NO: 885 and CDR-L3 as depicted in SEQ ID NO: 886;
- (f) CDR-H1 as depicted in SEQ ID NO: 891, CDR-H2 as depicted in SEQ ID NO: 892, CDR-H3 as depicted in SEQ ID NO: 893, CDR-L1 as depicted in SEQ ID NO: 894, CDR-L2 as depicted in SEQ ID NO: 895 and CDR-L3 as depicted in SEQ ID NO: 896;
- (g) CDR-H1 as depicted in SEQ ID NO: 901, CDR-H2 as depicted in SEQ ID NO: 902, CDR-H3 as depicted in SEQ ID NO: 903, CDR-L1 as depicted in SEQ ID NO: 904, CDR-L2 as depicted in SEQ ID NO: 905 and CDR-L3 as depicted in SEQ ID NO: 906;
- (h) CDR-H1 as depicted in SEQ ID NO: 911, CDR-H2 as depicted in SEQ ID NO: 912, CDR-H3 as depicted in SEQ ID NO: 913, CDR-L1 as depicted in SEQ ID NO: 914, CDR-L2 as depicted in SEQ ID NO: 915 and CDR-L3 as depicted in SEQ ID NO: 916;
- (i) CDR-H1 as depicted in SEQ ID NO: 921, CDR-H2 as depicted in SEQ ID NO: 922, CDR-H3 as depicted in SEQ ID NO: 923, CDR-L1 as depicted in SEQ ID NO: 924, CDR-L2 as depicted in SEQ ID NO: 925 and CDR-L3 as depicted in SEQ ID NO: 926;
- (k) CDR-H1 as depicted in SEQ ID NO: 931, CDR-H2 as depicted in SEQ ID NO: 932, CDR-H3 as depicted in SEQ ID NO: 933, CDR-L1 as depicted in SEQ ID NO: 934, CDR-L2 as depicted in SEQ ID NO: 935 and CDR-L3 as depicted in SEQ ID NO: 936;
- (l) CDR-H1 as depicted in SEQ ID NO: 941, CDR-H2 as depicted in SEQ ID NO: 942, CDR-H3 as depicted in SEQ ID NO: 943, CDR-L1 as depicted in SEQ ID NO: 944, CDR-L2 as depicted in SEQ ID NO: 945 and CDR-L3 as depicted in SEQ ID NO: 946; and
- (m) CDR-H1 as depicted in SEQ ID NO: 951, CDR-H2 as depicted in SEQ ID NO: 952, CDR-H3 as depicted in SEQ ID NO: 953, CDR-L1 as depicted in SEQ ID NO: 954, CDR-L2 as depicted in SEQ ID NO: 955 and CDR-L3 as depicted in SEQ ID NO: 956.

In yet another embodiment, the first binding domain of the binding molecule comprises a VH region selected from the group consisting of a VH region as depicted in SEQ ID NO: 847, SEQ ID NO: 857, SEQ ID NO: 867, SEQ ID NO: 877, SEQ ID NO: 887, SEQ ID NO: 897, SEQ ID NO: 907, SEQ ID NO: 917, SEQ ID NO: 927, SEQ ID NO: 937, SEQ ID NO: 947, and SEQ ID NO: 957.

In another embodiment, the first binding domain of the binding molecule comprises a VL region selected from the group consisting of a VL region as depicted in SEQ ID NO: 848, SEQ ID NO: 858, SEQ ID NO: 868, SEQ ID NO: 878, SEQ ID NO: 888, SEQ ID NO: 898, SEQ ID NO: 908, SEQ ID NO: 918, SEQ ID NO: 928, SEQ ID NO: 938, SEQ ID NO: 948, and SEQ ID NO: 958.

In one embodiment, the first binding domain of the binding molecule comprises a VH region and a VL region selected from the group consisting of:
- (a) a VH region as depicted in SEQ ID NO: 847, and a VL region as depicted in SEQ ID NO: 848;
- (b) a VH region as depicted in SEQ ID NO: 857, and a VL region as depicted in SEQ ID NO: 858;
- (c) a VH region as depicted in SEQ ID NO: 867, and a VL region as depicted in SEQ ID NO: 868;
- (d) a VH region as depicted in SEQ ID NO: 877, and a VL region as depicted in SEQ ID NO: 878;
- (e) a VH region as depicted in SEQ ID NO: 887, and a VL region as depicted in SEQ ID NO: 888;
- (f) a VH region as depicted in SEQ ID NO: 897, and a VL region as depicted in SEQ ID NO: 898;
- (g) a VH region as depicted in SEQ ID NO: 907, and a VL region as depicted in SEQ ID NO: 908;
- (h) a VH region as depicted in SEQ ID NO: 917, and a VL region as depicted in SEQ ID NO: 918;
- (i) a VH region as depicted in SEQ ID NO: 927, and a VL region as depicted in SEQ ID NO: 928;
- (k) a VH region as depicted in SEQ ID NO: 937, and a VL region as depicted in SEQ ID NO: 938;
- (l) a VH region as depicted in SEQ ID NO: 947, and a VL region as depicted in SEQ ID NO: 948; and
- (m) a VH region as depicted in SEQ ID NO: 957, and a VL region as depicted in SEQ ID NO: 958.

In one example, the first binding domain comprises an amino acid sequence selected from the group consisting of SEQ ID NO: 849, SEQ ID NO: 859, SEQ ID NO: 869, SEQ ID NO: 879, SEQ ID NO: 889, SEQ ID NO: 899, SEQ ID NO: 909, SEQ ID NO: 919, SEQ ID NO: 929, SEQ ID NO: 939, SEQ ID NO: 949, and SEQ ID NO: 959.

The fourth group of binding molecules also relates to the following items:
1. A binding molecule comprising a first and a second binding domain, wherein
   - (a) the first binding domain is capable of binding to
     - (i) the extracellular domain of human BCMA corresponding to the amino acid sequence as depicted in SEQ ID NO: 1007, and
     - (ii) at least one of the chimeric extracellular domains of BCMA selected from the group consisting of BCMA domains corresponding to the amino acid sequences as depicted in SEQ ID NO: 1009, SEQ ID NO: 1010, SEQ ID NO: 1011, SEQ ID NO: 1012, SEQ ID NO: 1013, SEQ ID NO: 1014 and SEQ ID NO: 1015; and
(b) the second binding domain is capable of binding to the T cell CD3 receptor complex.

2. The binding molecule according to item 1, wherein the first binding domain is further capable of binding to macaque BCMA.

3. The binding molecule according to item 1 or 2, wherein the second binding domain is capable of binding to CD3 epsilon.

4. The binding molecule according to any one of the preceding items, wherein the second binding domain is capable of binding to human CD3 and to macaque CD3.

5. The binding molecule according to any of the preceding items, wherein the first binding domain is not capable of binding to the extracellular domain of murine BCMA corresponding to the amino acid sequence as depicted in SEQ ID NO: 1008.

6. The binding molecule according to any one of the preceding items, wherein the first and/or the second binding domain are derived from an antibody.

7. The binding molecule according to item 6, which is selected from the group consisting of (scFv)₂, (single domain mAb)₂, scFv-single domain mAb, diabodies and oligomers thereof.

8. The binding molecule according to any one of the preceding items, wherein the first binding domain comprises a VH region comprising CDR-H1, CDR-H2 and CDR-H3 and a VL region comprising CDR-L1, CDR-L2 and CDR-L3 selected from the group consisting of:
(a) CDR-H1 as depicted in SEQ ID NO: 841, CDR-H2 as depicted in SEQ ID NO: 842, CDR-H3 as depicted in SEQ ID NO: 843, CDR-L1 as depicted in SEQ ID NO: 844, CDR-L2 as depicted in SEQ ID NO: 845 and CDR-L3 as depicted in SEQ ID NO: 846;
(b) CDR-H1 as depicted in SEQ ID NO: 851, CDR-H2 as depicted in SEQ ID NO: 852, CDR-H3 as depicted in SEQ ID NO: 853, CDR-L1 as depicted in SEQ ID NO: 854, CDR-L2 as depicted in SEQ ID NO: 855 and CDR-L3 as depicted in SEQ ID NO: 856;
(c) CDR-H1 as depicted in SEQ ID NO: 861, CDR-H2 as depicted in SEQ ID NO: 862, CDR-H3 as depicted in SEQ ID NO: 863, CDR-L1 as depicted in SEQ ID NO: 864, CDR-L2 as depicted in SEQ ID NO: 865 and CDR-L3 as depicted in SEQ ID NO: 866;
(d) CDR-H1 as depicted in SEQ ID NO: 871, CDR-H2 as depicted in SEQ ID NO: 872, CDR-H3 as depicted in SEQ ID NO: 873, CDR-L1 as depicted in SEQ ID NO: 874, CDR-L2 as depicted in SEQ ID NO: 875 and CDR-L3 as depicted in SEQ ID NO: 876;
(e) CDR-H1 as depicted in SEQ ID NO: 881, CDR-H2 as depicted in SEQ ID NO: 882, CDR-H3 as depicted in SEQ ID NO: 883, CDR-L1 as depicted in SEQ ID NO: 884, CDR-L2 as depicted in SEQ ID NO: 885 and CDR-L3 as depicted in SEQ ID NO: 886;
(f) CDR-H1 as depicted in SEQ ID NO: 891, CDR-H2 as depicted in SEQ ID NO: 892, CDR-H3 as depicted in SEQ ID NO: 893, CDR-L1 as depicted in SEQ ID NO: 894, CDR-L2 as depicted in SEQ ID NO: 895 and CDR-L3 as depicted in SEQ ID NO: 896;
(g) CDR-H1 as depicted in SEQ ID NO: 901, CDR-H2 as depicted in SEQ ID NO: 902, CDR-H3 as depicted in SEQ ID NO: 903, CDR-L1 as depicted in SEQ ID NO: 904, CDR-L2 as depicted in SEQ ID NO: 905 and CDR-L3 as depicted in SEQ ID NO: 906;
(h) CDR-H1 as depicted in SEQ ID NO: 911, CDR-H2 as depicted in SEQ ID NO: 912, CDR-H3 as depicted in SEQ ID NO: 913, CDR-L1 as depicted in SEQ ID NO: 914, CDR-L2 as depicted in SEQ ID NO: 915 and CDR-L3 as depicted in SEQ ID NO: 916;
(i) CDR-H1 as depicted in SEQ ID NO: 921, CDR-H2 as depicted in SEQ ID NO: 922, CDR-H3 as depicted in SEQ ID NO: 923, CDR-L1 as depicted in SEQ ID NO: 924, CDR-L2 as depicted in SEQ ID NO: 925 and CDR-L3 as depicted in SEQ ID NO: 926;
(k) CDR-H1 as depicted in SEQ ID NO: 931, CDR-H2 as depicted in SEQ ID NO: 932, CDR-H3 as depicted in SEQ ID NO: 933, CDR-L1 as depicted in SEQ ID NO: 934, CDR-L2 as depicted in SEQ ID NO: 935 and CDR-L3 as depicted in SEQ ID NO: 936;
(l) CDR-H1 as depicted in SEQ ID NO: 941, CDR-H2 as depicted in SEQ ID NO: 942, CDR-H3 as depicted in SEQ ID NO: 943, CDR-L1 as depicted in SEQ ID NO: 944, CDR-L2 as depicted in SEQ ID NO: 945 and CDR-L3 as depicted in SEQ ID NO: 946; and
(m) CDR-H1 as depicted in SEQ ID NO: 951, CDR-H2 as depicted in SEQ ID NO: 952, CDR-H3 as depicted in SEQ ID NO: 953, CDR-L1 as depicted in SEQ ID NO: 954, CDR-L2 as depicted in SEQ ID NO: 955 and CDR-L3 as depicted in SEQ ID NO: 956.

9. The binding molecule according to any one of the preceding items, wherein the first binding domain comprises a VH region selected from the group consisting of VH regions as depicted in SEQ ID NO: 847, SEQ ID NO: 857, SEQ ID NO: 867, SEQ ID NO: 877, SEQ ID NO: 887, SEQ ID NO: 897, SEQ ID NO: 907, SEQ ID NO: 917, SEQ ID NO: 927, SEQ ID NO: 937, SEQ ID NO: 947, and SEQ ID NO: 957.

10. The binding molecule according to any one of the preceding items, wherein the first binding domain comprises a VL region selected from the group consisting of VL regions as depicted in SEQ ID NO: 848, SEQ ID NO: 858, SEQ ID NO: 868, SEQ ID NO: 878, SEQ ID NO: 888, SEQ ID NO: 898, SEQ ID NO: 908, SEQ ID NO: 918, SEQ ID NO: 928, SEQ ID NO: 938, SEQ ID NO: 948, and SEQ ID NO: 958.

11. The binding molecule according to any one of the preceding items, wherein the first binding domain comprises a VH region and a VL region selected from the group consisting of:
(a) a VH region as depicted in SEQ ID NO: 847, and a VL region as depicted in SEQ ID NO: 848;
(b) a VH region as depicted in SEQ ID NO: 857, and a VL region as depicted in SEQ ID NO: 858;
(c) a VH region as depicted in SEQ ID NO: 867, and a VL region as depicted in SEQ ID NO: 868;
(d) a VH region as depicted in SEQ ID NO: 877, and a VL region as depicted in SEQ ID NO: 878;
(e) a VH region as depicted in SEQ ID NO: 887, and a VL region as depicted in SEQ ID NO: 888;
(f) a VH region as depicted in SEQ ID NO: 897, and a VL region as depicted in SEQ ID NO: 898;
(g) a VH region as depicted in SEQ ID NO: 907, and a VL region as depicted in SEQ ID NO: 908;
(h) a VH region as depicted in SEQ ID NO: 917, and a VL region as depicted in SEQ ID NO: 918;
(i) a VH region as depicted in SEQ ID NO: 927, and a VL region as depicted in SEQ ID NO: 928;
(k) a VH region as depicted in SEQ ID NO: 937, and a VL region as depicted in SEQ ID NO: 938;
(l) a VH region as depicted in SEQ ID NO: 947, and a VL region as depicted in SEQ ID NO: 948; and
(m) a VH region as depicted in SEQ ID NO: 957, and a VL region as depicted in SEQ ID NO: 958.

12. The binding molecule according to item 11, wherein the first binding domain comprises an amino acid sequence selected from the group consisting of SEQ ID NO: 849, SEQ ID NO: 859, SEQ ID NO: 869, SEQ ID NO: 879, SEQ ID NO: 889, SEQ ID NO: 899, SEQ ID NO: 909, SEQ ID NO: 919, SEQ ID NO: 929, SEQ ID NO: 939, SEQ ID NO: 949, and SEQ ID NO: 959.

13. A nucleic acid sequence encoding a binding molecule as defined in any one of items 1 to 12.

14. A vector comprising a nucleic acid sequence as defined in item 13.

15. A host cell transformed or transfected with the nucleic acid sequence as defined in item 13 or with the vector as defined in item 14.

16. A process for the production of a binding molecule according to any one of items 1 to 12, said process comprising culturing a host cell as defined in item 15 under conditions allowing the expression of the binding molecule as defined in any one of items 1 to 12 and recovering the produced binding molecule from the culture.

17. A pharmaceutical composition comprising a binding molecule according to any one of items 1 to 12, or produced according to the process of item 16.

18. The binding molecule according to any one of items 1 to 12, or produced according to the process of item 16 for use in the prevention, treatment or amelioration of a disease selected from the group consisting of plasma cell disorders, other B cell disorders that correlate with BCMA expression and autoimmune diseases.

19. A method for the treatment or amelioration of a disease selected from the group consisting of plasma cell disorders, other B cell disorders that correlate with BCMA expression and autoimmune diseases, comprising the step of administering to a subject in need thereof the binding molecule according to any one of items 1 to 12, or produced according to the process of item 16.

20. The method according to item 19, wherein the plasma cell disorder is selected from the group consisting of multiple myeloma, plasmacytoma, plasma cell leukemia, macroglobulinemia, amyloidosis, Waldenstrom's macroglobulinemia, solitary bone plasmacytoma, extramedullary plasmacytoma, osteosclerotic myeloma, heavy chain diseases, monoclonal gammopathy of undetermined significance, and smoldering multiple myeloma.

21. The method according to item 19, wherein the autoimmune disease is systemic lupus erythematodes.

22. A kit comprising a binding molecule as defined in any one of items 1 to 12, a nucleic acid molecule as defined in item 13, a vector as defined in item 14, or a host cell as defined in item 15.

It should be understood that the inventions herein are not limited to particular methodology, protocols, or reagents, as such can vary. The discussion and examples provided herein are presented for the purpose of describing particular embodiments only and are not intended to limit the scope of the present invention, which is defined solely by the claims.

All publications and patents cited throughout the text of this specification (including all patents, patent applications, scientific publications, manufacturer's specifications, instructions, etc.), whether supra or infra, are hereby incorporated by reference in their entirety. Nothing herein is to be construed as an admission that the invention is not entitled to antedate such disclosure by virtue of prior invention. To the extent the material incorporated by reference contradicts or is inconsistent with this specification, the specification will supersede any such material.

The following denomination of the figures and examples represents their correlation with one of the groups (A) to (D) of the binding molecules described herein above. In other words, Figures A [+number] and Examples A [+number] refer to group (A), Figures B [+number] and Examples B [+number] refer to group (B), Figures C [+number] and Examples C [+number] refer to group (C), and Figures D [+number] and Examples D [+number] refer to group (D).

THE FIGURES SHOW

FIG. 1:
Sequence alignment of the extracellular domain (ECD) of human BCMA (amino acid residues 1-54 of the full-length protein) and murine BCMA (amino acid residues 1-49 of the full-length protein). Highlighted are the regions (domains or amino acid residues) which were exchanged in the chimeric constructs, as designated for the epitope clustering. Cysteines are depicted by black boxes. Disulfide bonds are indicated.

Figure 2A:
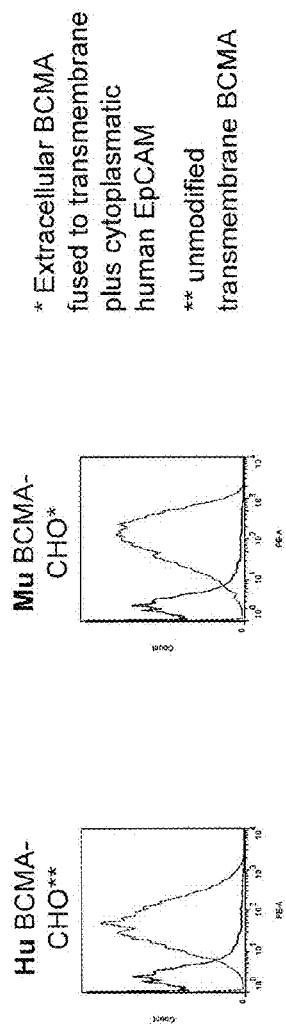
Figure 2B:
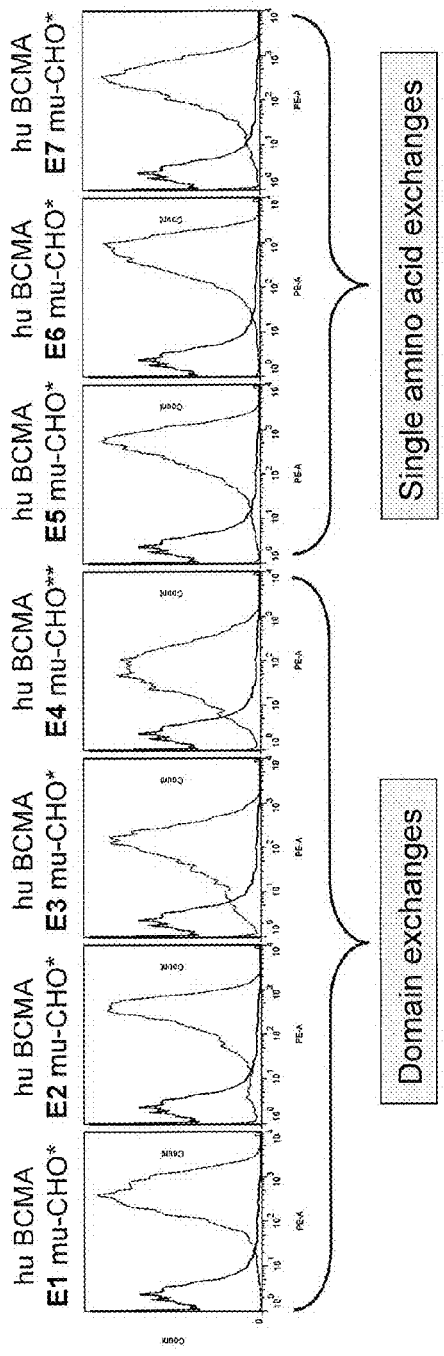

FIGS. 2A and 2B:
Epitope mapping of the BCMA constructs. Human and murine BCMA FIG. 2A as well as seven chimeric human-murine BCMA constructs FIG. 2B expressed on the surface of CHO cells as shown by flow cytometry. The expression of human BCMA on CHO was detected with a monoclonal anti-human BCMA antibody. Murine BCMA expression was detected with a monoclonal anti-murine BCMA-antibody. Bound monoclonal antibody was detected with an anti-rat IgG-Fc-gamma-specific antibody conjugated to phycoerythrin.

Figure 3A:
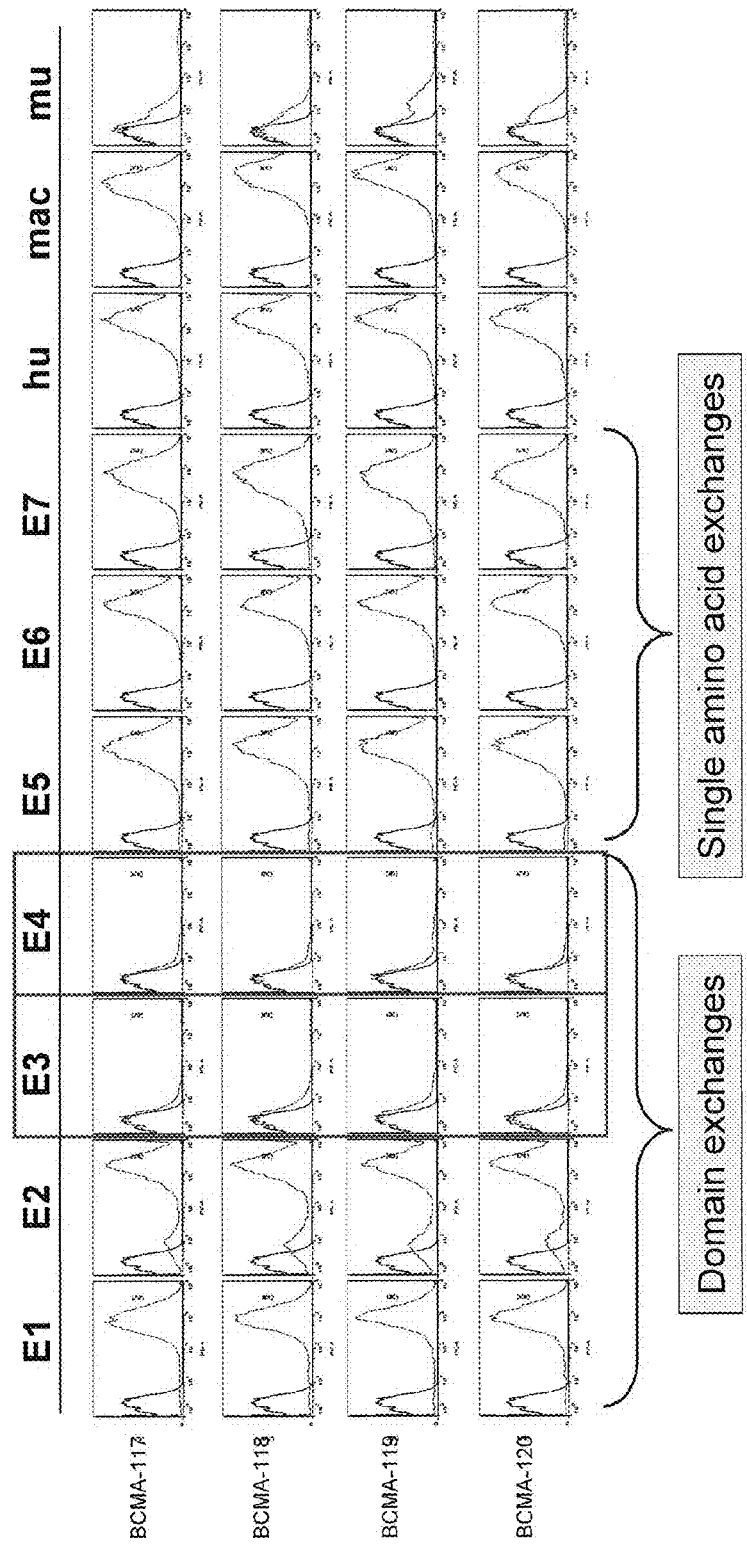
Figure 3A:
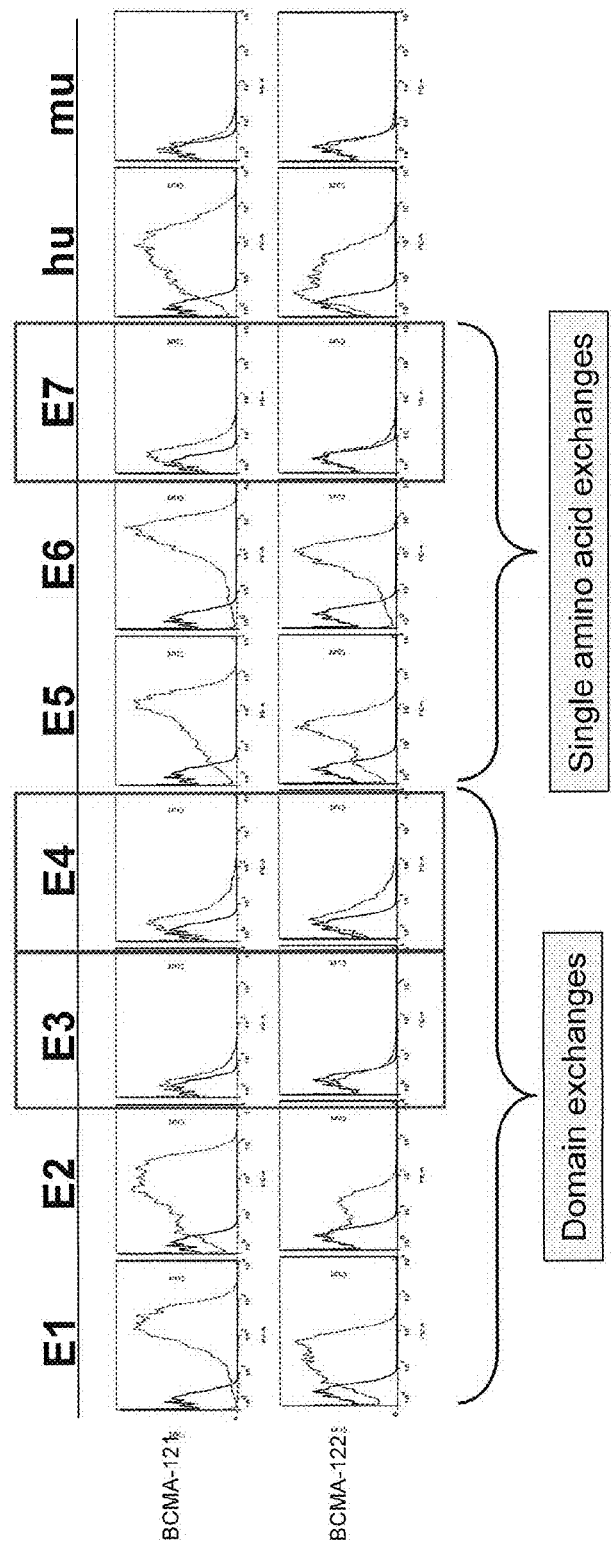
Figure 3B:
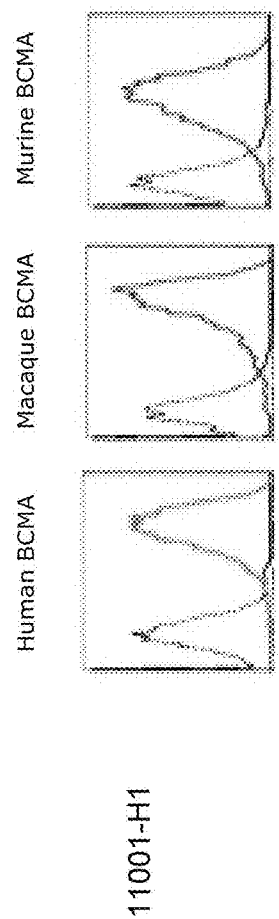

FIG. 3A:
Examples of binding molecules specific for epitope clusters E3 and E4, as detected in the epitope mapping of the chimeric BCMA constructs (see example A3). Some binding molecules are additionally capable of binding to the amino acid residue arginine at position 39 ("E7") of human BCMA FIG. 3B:
Example of a binding molecule specific for human and murine BCMA (see example B3)

Figure 3C:
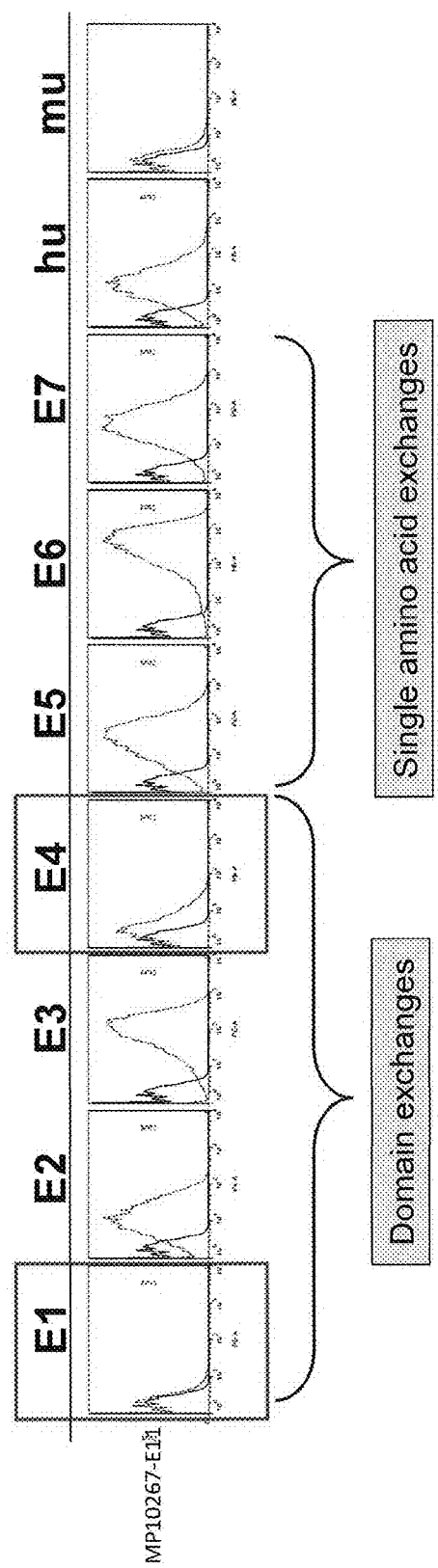

FIG. 3C:
Example of a binding molecule specific for epitope clusters E1 and E4, as detected in the epitope mapping of the chimeric BCMA constructs (see example C3).

Figure 3D:
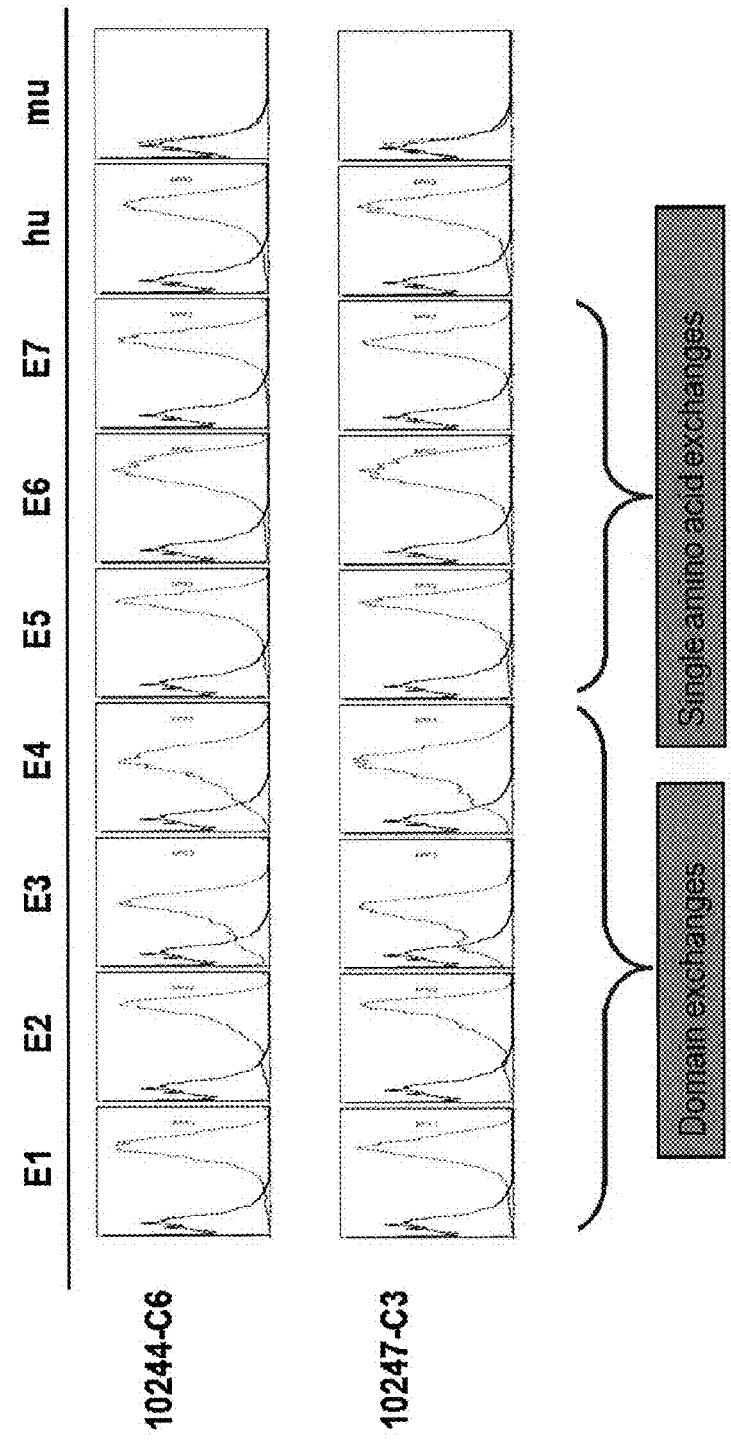

FIG. 3D:
Example of a binding molecule which binds to human BCMA, is not cross-reactive with murine BCMA and which additionally binds to the different chimeric BCMA constructs, as detected in the epitope mapping (see example D3).

FIG. 4A:
Determination of binding constants of bispecific binding molecules (anti BCMAxanti CD3) on human and macaque BCMA using the Biacore system. Antigen was immobilized in low to intermediate density (100 RU) on CM5 chip. Dilutions of binders were floated over the chip surface and binding determined using BiaEval Software. Respective off-rates and the binding constant (KD) of the respective binders are depicted below every graph.

Figure 4B:
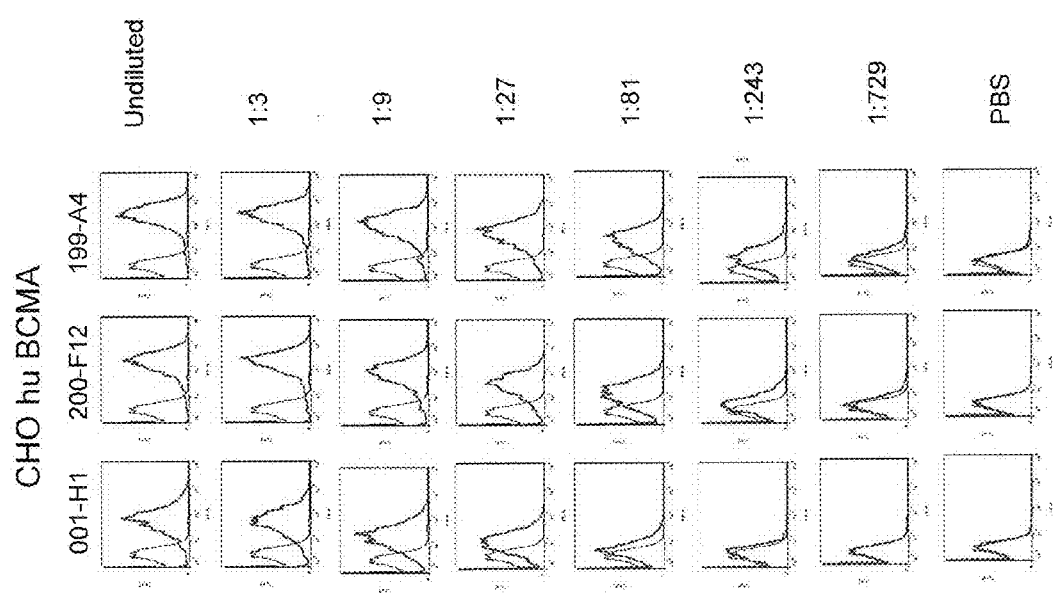

FIG. 4B:
Functionality and binding strength of affinity matured scFv molecules were analyzed in FACS using human BCMA transfected CHO cells. The results are depicted as FACS histograms of serial 1:3 dilutions of periplasmatic *E. coli* cell extracts, plotting the log of fluorescence intensity versus relative cell number.

Figure 4C:
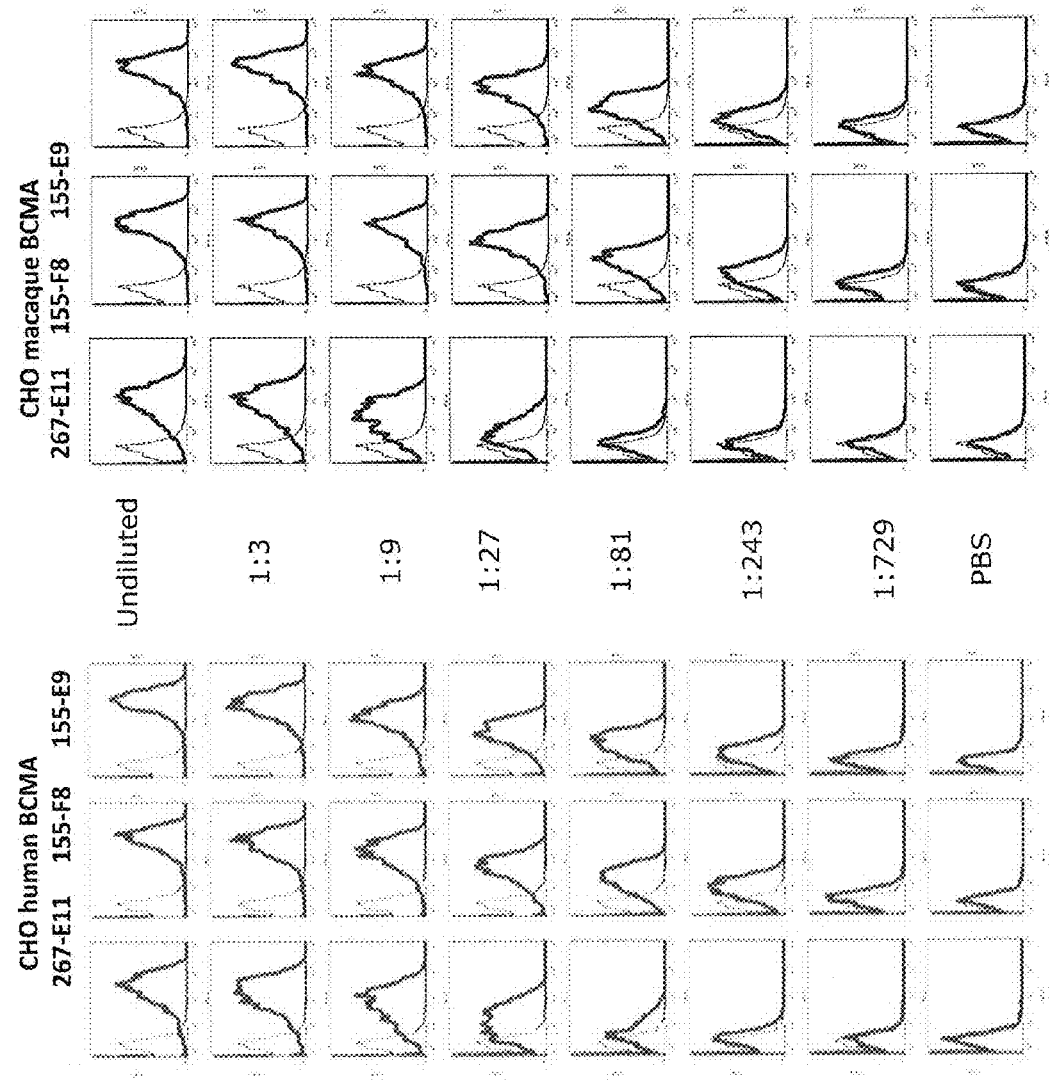
Figure 4D:
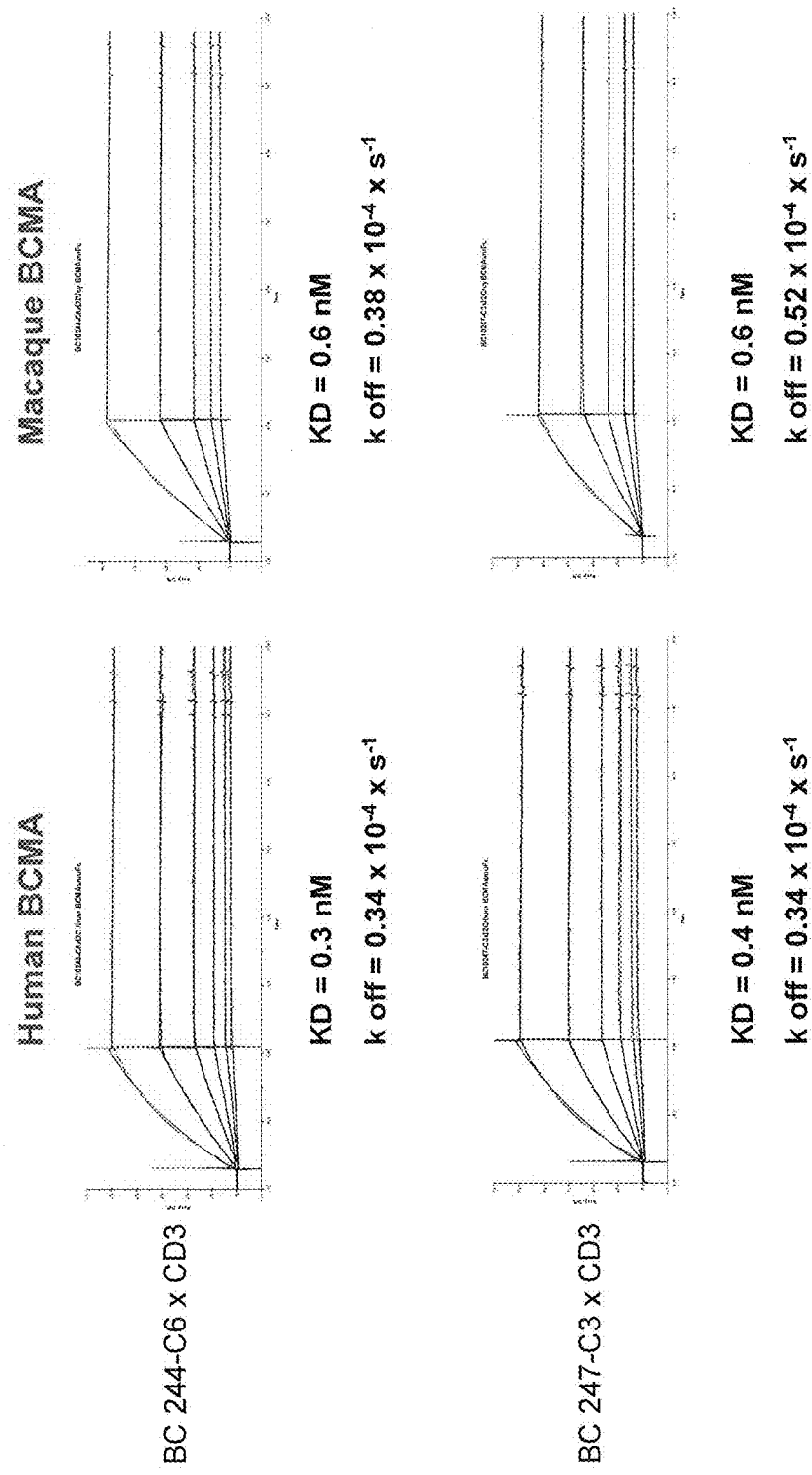
Figure 5A:
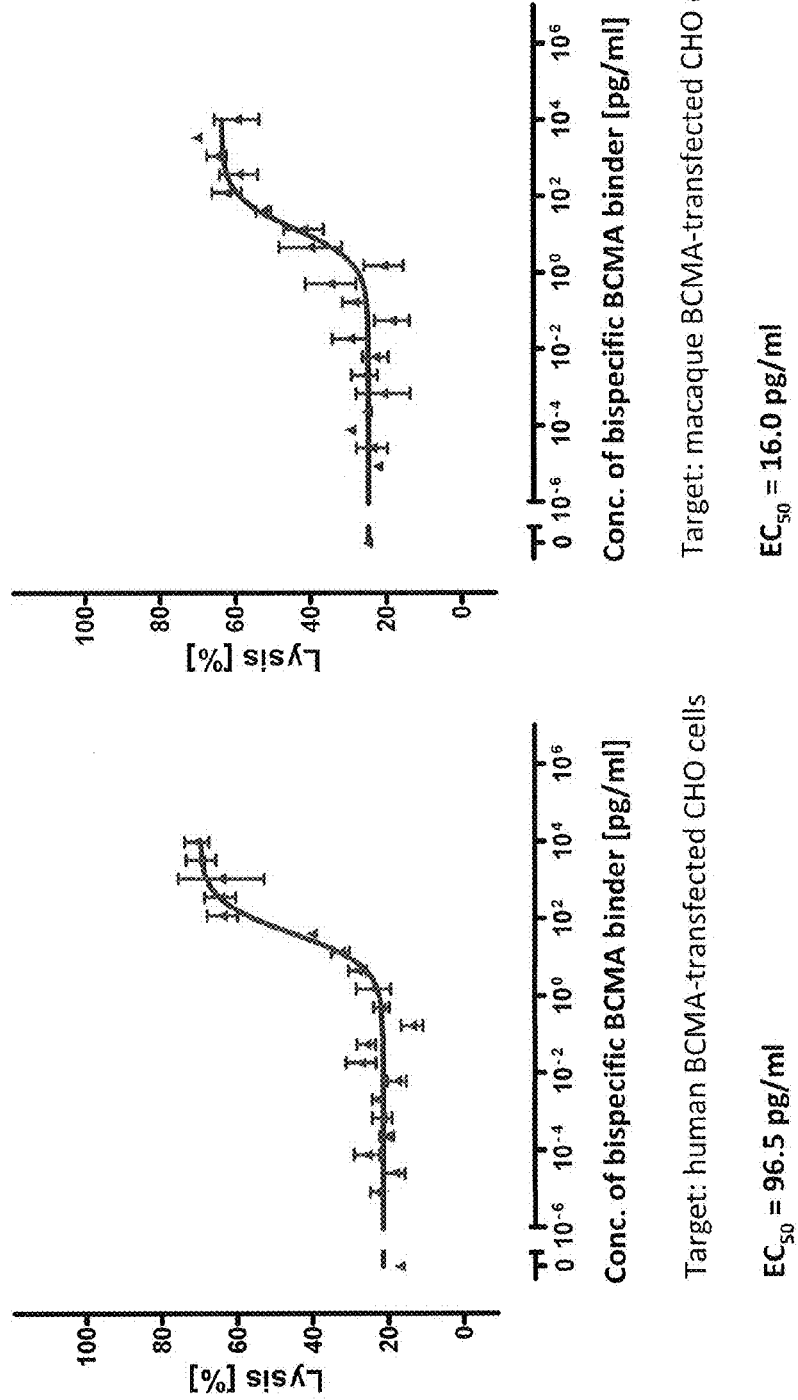
Figure 5B:
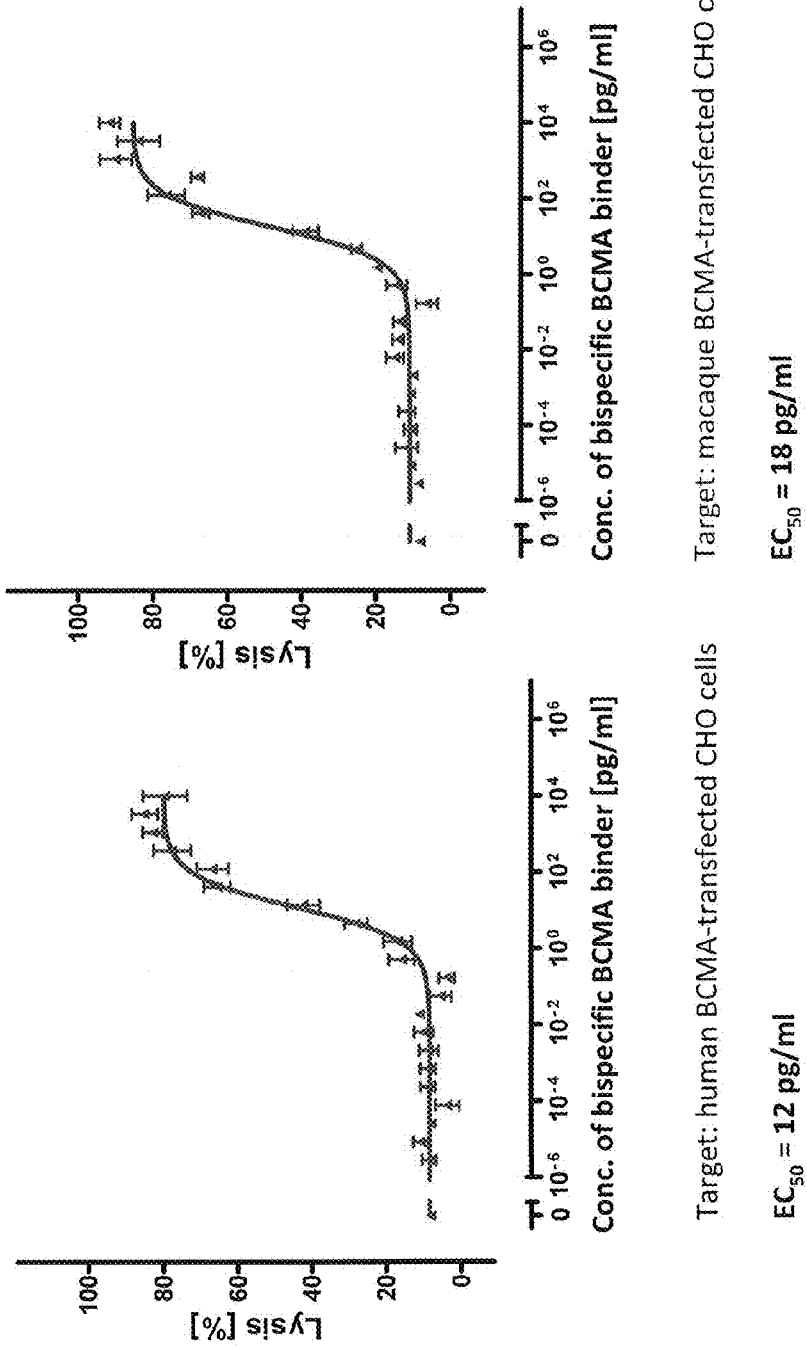
Figure 6:
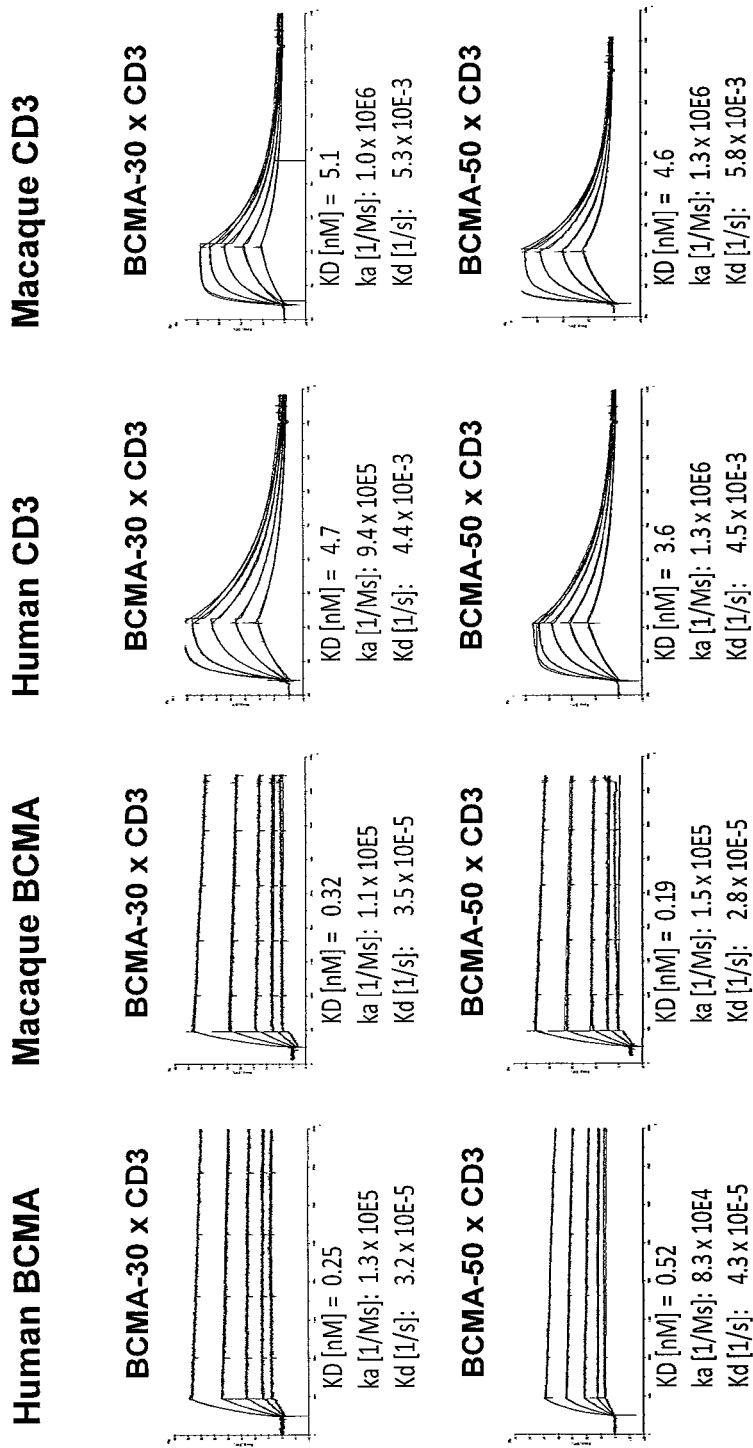
Figure 7:
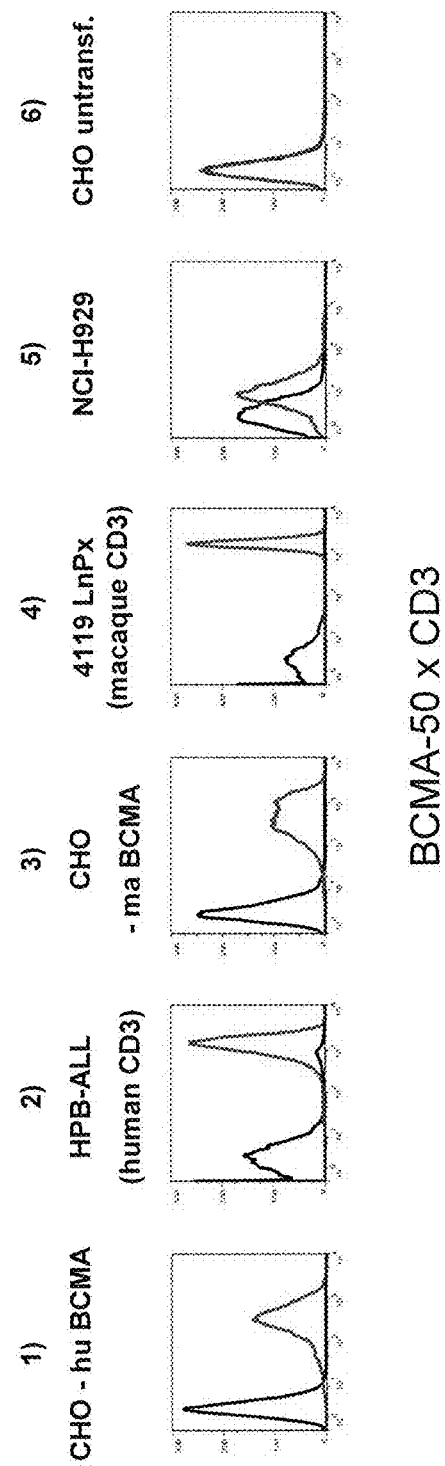
Figure 8:
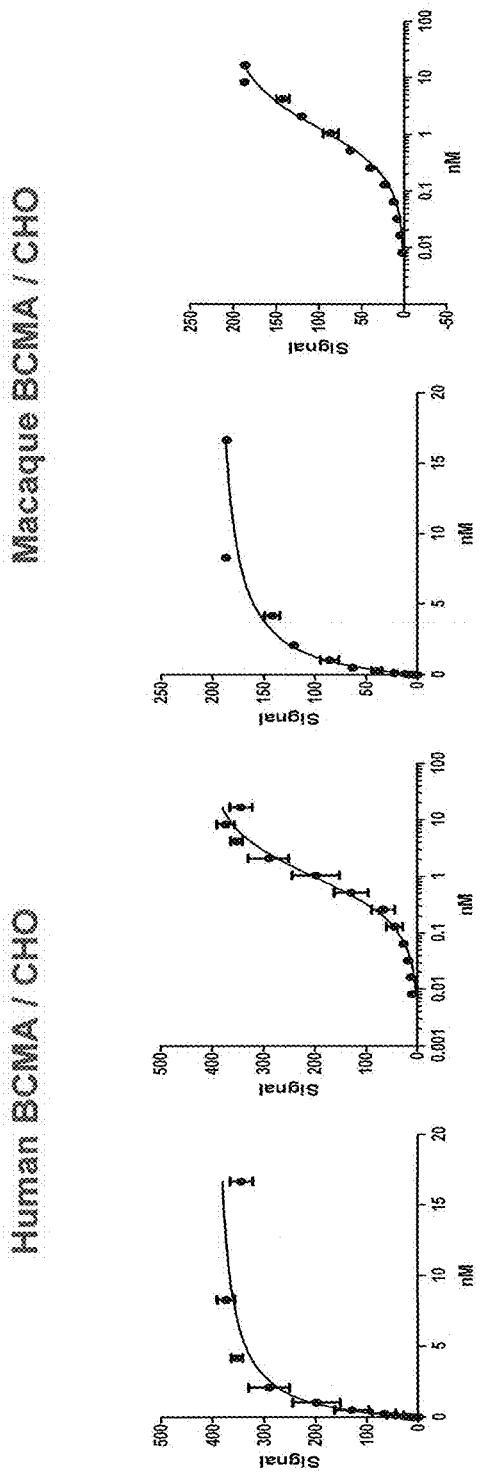
Figure 9:
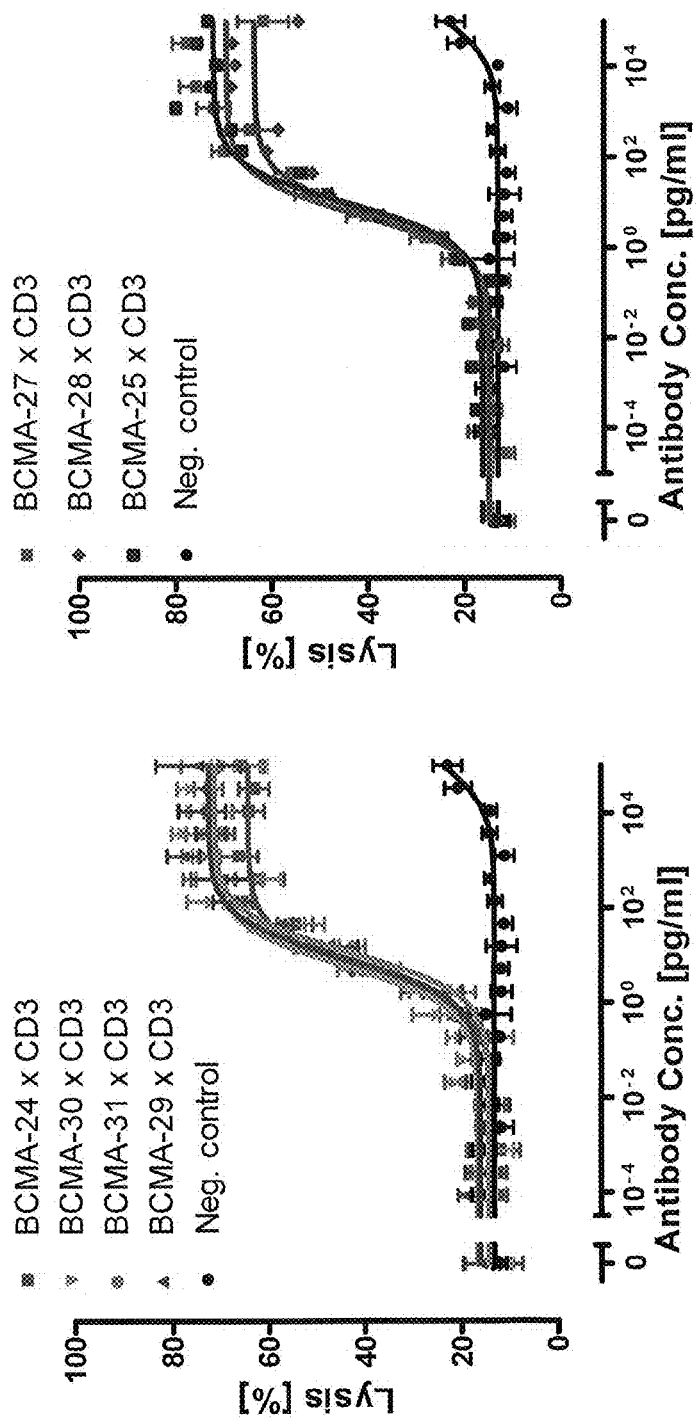
Figure 9:
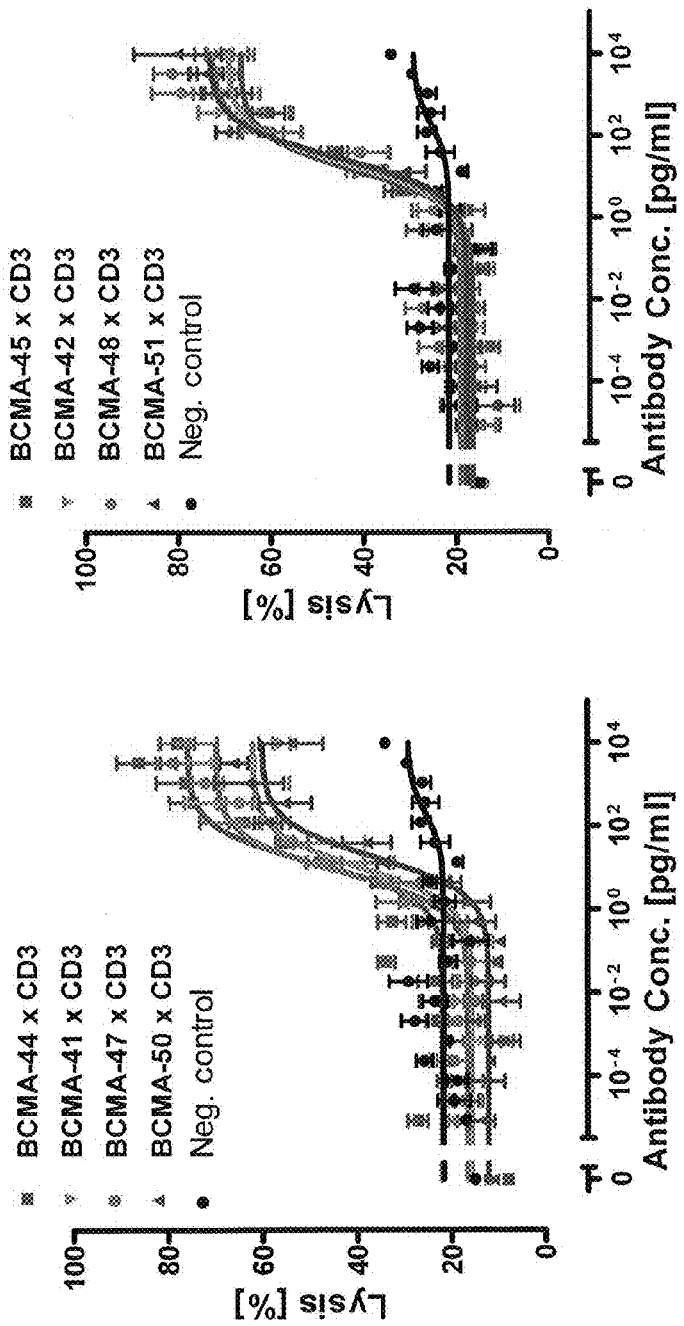
Figure 10:
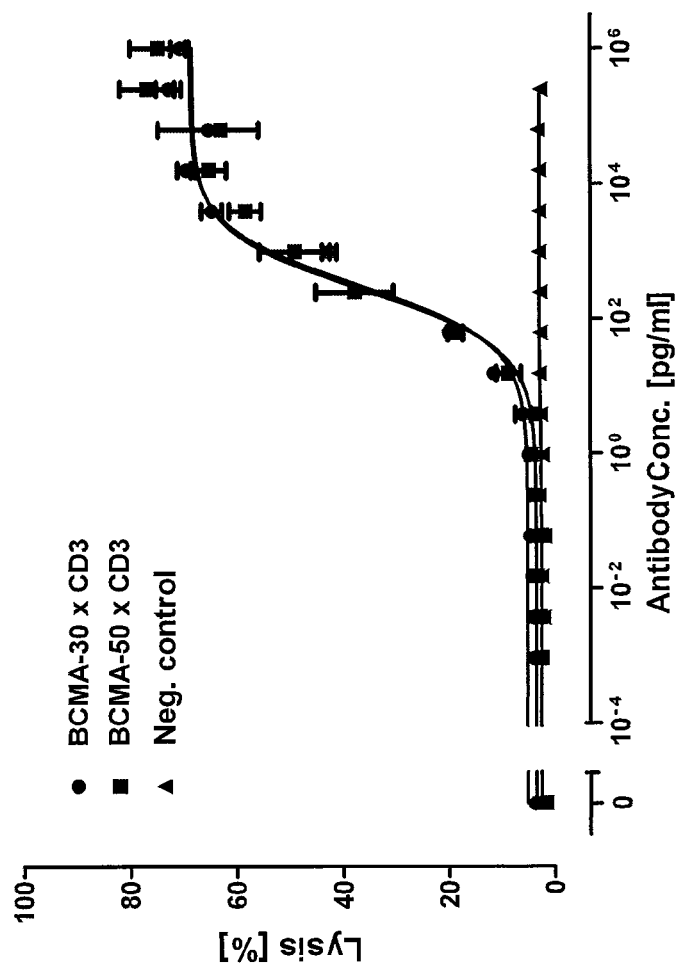
Figure 11:
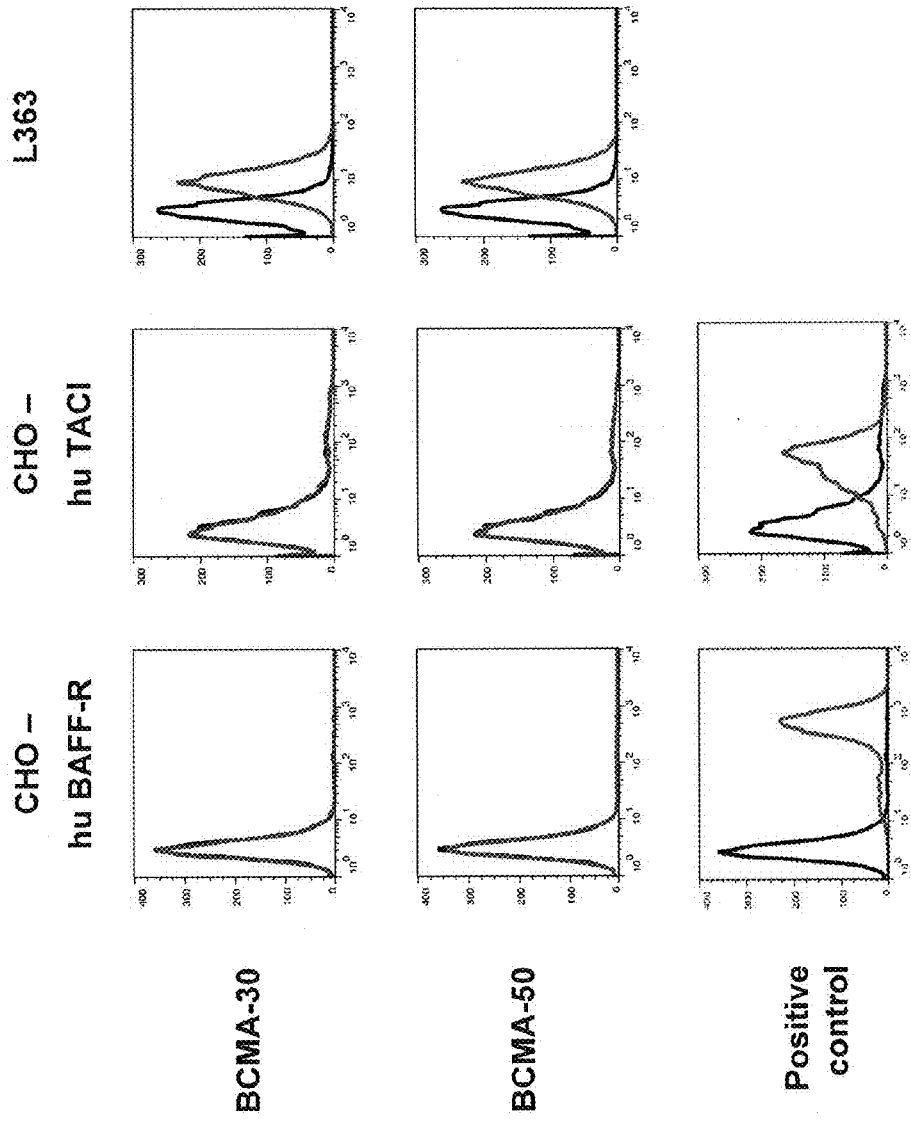
Figure 12:
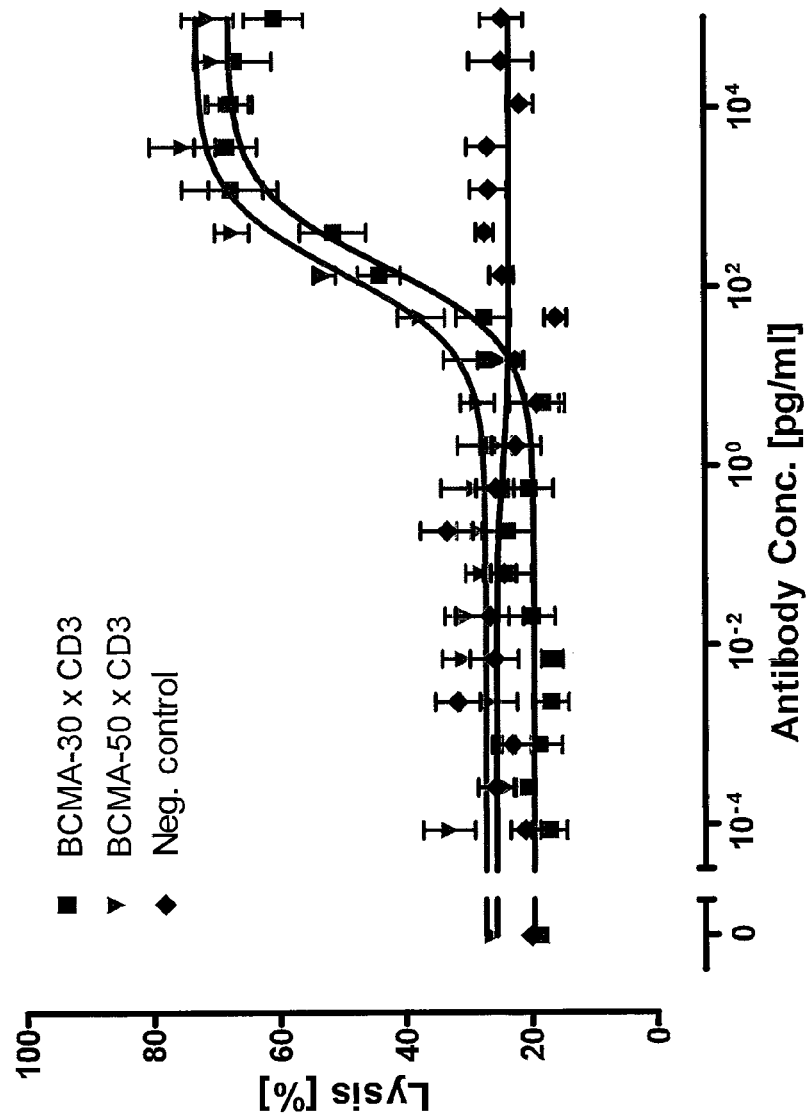
Figure 13:
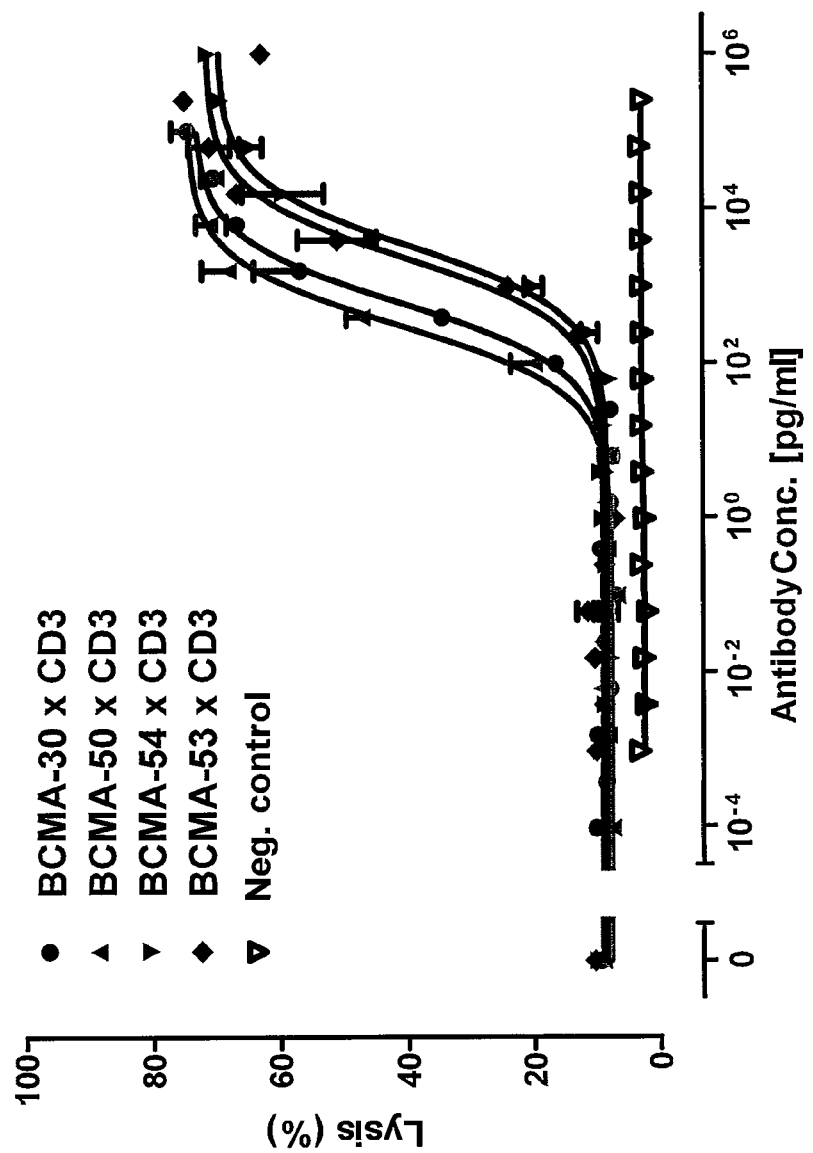
Figure 14:
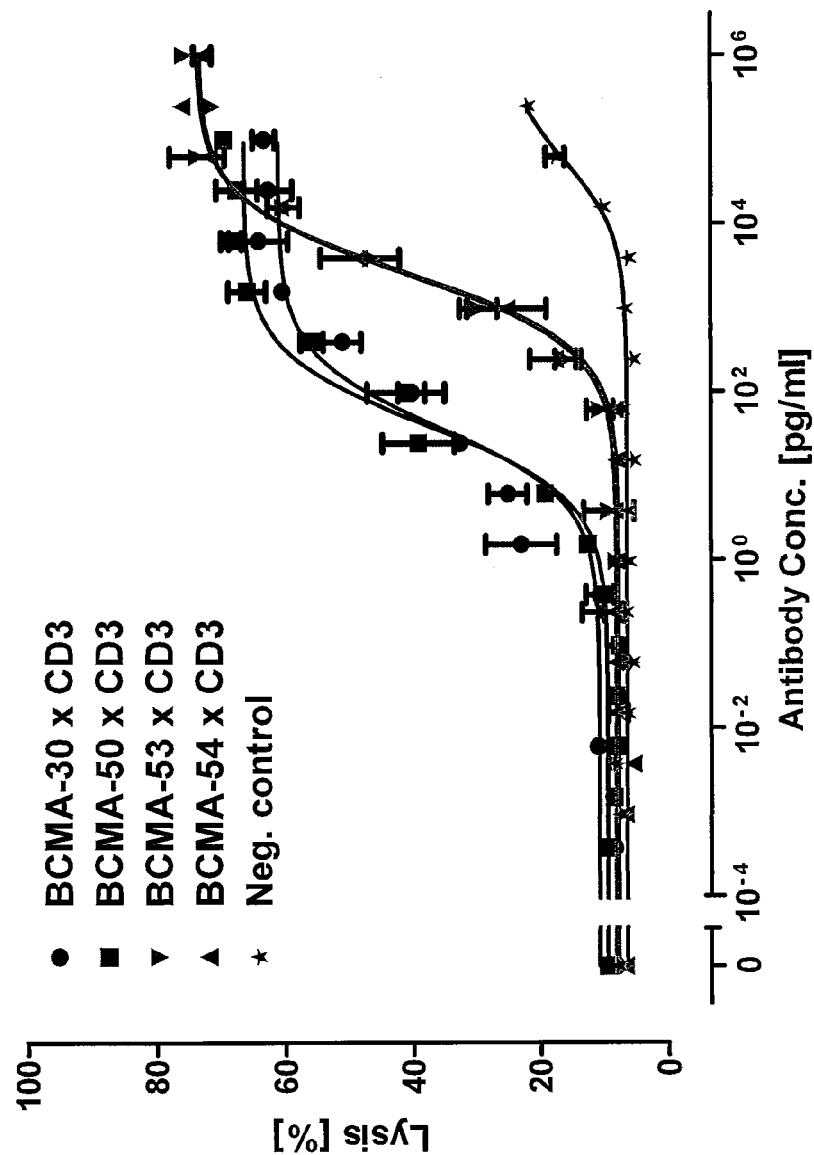
Figure 15:
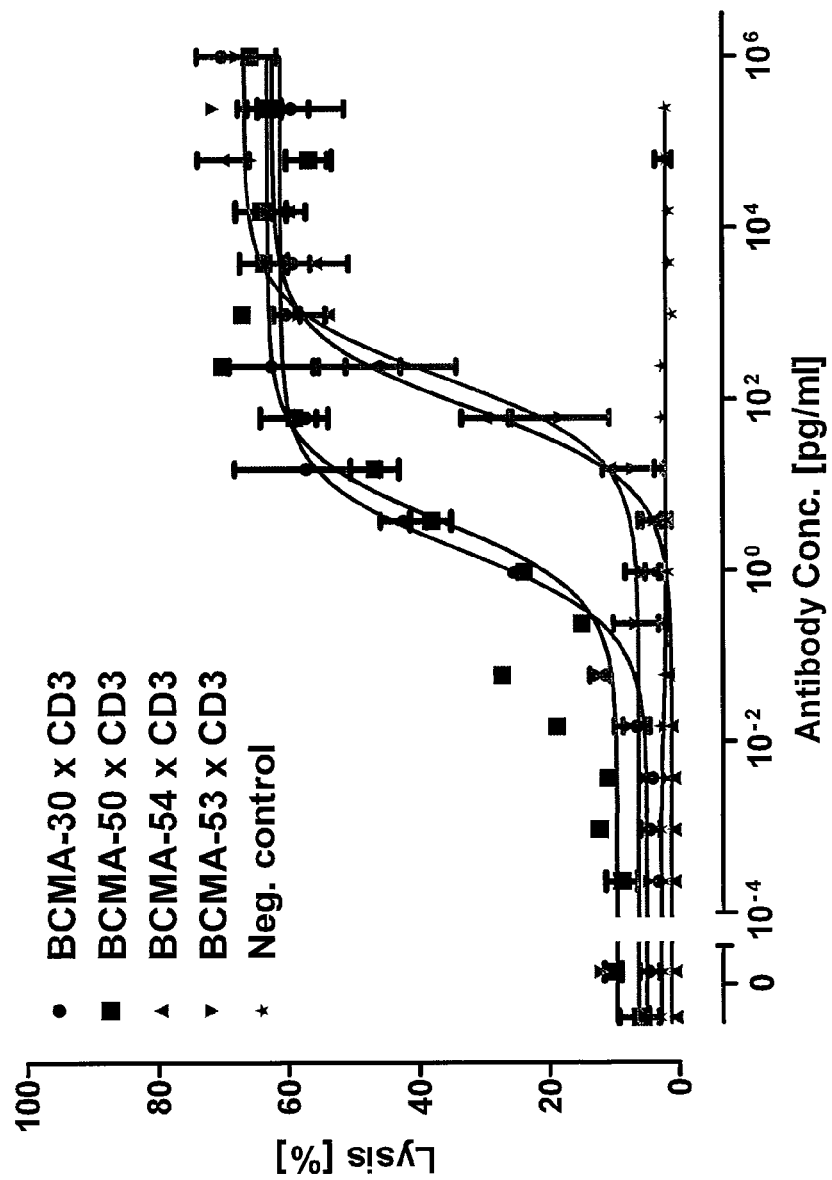

FIG. 4C:
Functionality and binding strength of affinity matured scFv molecules were analyzed in FACS using human BCMA and macaque BCMA transfected CHO cells. The results are depicted as FACS histograms of serial 1:3 dilutions of periplasmatic *E. coli* cell extracts, plotting the log of fluorescence intensity versus relative cell number.

FIG. 4D:

Determination of binding constants of bispecific binding molecules (anti BCMA×anti CD3) on human and macaque BCMA using the Biacore system. Antigen was immobilized in low to intermediate density (100 RU) on CM5 chip. Dilutions of binders were floated over the chip surface and binding determined using BiaEval Software. Respective off-rates and the binding constant (KD) of the respective binders are depicted below every graph.

FIG. 5A:

Cytotoxic activity of BCMA bispecific antibodies as measured in an 18-hour $^{51}$chromium release assay. Effector cells: stimulated enriched human CD8 T cells. Target cells: Human BCMA transfected CHO cells (left figure) and macaque BCMA transfected CHO cells (right figure). Effector to target cell (E:T) ratio: 10:1.

FIG. 5B:

Cytotoxic activity of BCMA bispecific antibodies as measured in an 18-hour $^{51}$chromium release assay. Effector cells: stimulated enriched human CD8 T cells. Target cells: Human BCMA transfected CHO cells (left figure) and macaque BCMA transfected CHO cells (right figure). Effector to target cell (E:T) ratio: 10:1.

FIG. 6

Determination of binding constants of BCMA/CD3 bispecific antibodies of epitope cluster E3/E4±E7 on human and macaque BCMA and on human and macaque CD3 using the Biacore system. Antigen was immobilized in low to intermediate density (100-200 RU) on CM5 chip. Dilutions of bispecific antibodies were floated over the chip surface and binding determined using BiaEval Software. Respective on- and off-rates and the resulting binding constant (KD) of the respective bispecific antibodies are depicted below every graph.

FIG. 7

FACS analysis of BCMA/CD3 bispecific antibodies of epitope cluster E3/E4±E7 on indicated cell lines: 1) human BCMA transfected CHO cells, 2) human CD3 positive human T cell line HBP-ALL, 3) macaque BCMA transfected CHO cells, 4) macaque T cell line 4119 LnPx, 5) BCMA-positive human multiple myeloma cell line NCI-H929 and 6) untransfected CHO cells. Negative controls [1) to 6)]: detection antibodies without prior BCMA/CD3 bispecific antibody.

FIG. 8

Scatchard analysis of BCMA/CD3 bispecific antibodies on BCMA-expressing cells. Cells were incubated with increasing concentrations of monomeric antibody until saturation. Antibodies were detected by flow cytometry. Values of triplicate measurements were plotted as hyperbolic curves and as sigmoid curves to demonstrate a valid concentration range used. Maximal binding was determined using Scatchard evaluation, and the respective KD values were calculated.

FIG. 9

Cytotoxic activity of BCMA/CD3 bispecific antibodies of epitope cluster E3/E4±E7, as measured in an 18-hour 51-chromium release assay against CHO cells transfected with human BCMA. Effector cells: stimulated enriched human CD8 T cells. Effector to target cell (E:T) ratio: 10:1.

FIG. 10

Cytotoxic activity of BCMA/CD3 bispecific antibodies of epitope cluster E3/E4±E7 as measured in a 48-hour FACS-based cytotoxicity assay. Effector cells: unstimulated human PBMC. Target cells: CHO cells transfected with human BCMA. Effector to target cell (E:T)-ratio: 10:1.

FIG. 11

FACS analysis of BCMA/CD3 bispecific antibodies of epitope cluster E3/E4±E7 on BAFF-R and TACI transfected CHO cells. Cell lines: 1) human BAFF-R transfected CHO cells, 2) human TACI transfected CHO cells 3) multiple myeloma cell line L363; negative controls: detection antibodies without prior BCMA/Cd3 bispecific antibody. Positive controls: BAFF-R detection: goat anti hu BAFF-R (R&D AF1162; 1:20) detected by anti-goat antibody-PE (Jackson 705-116-147; 1:50) TACI-detection: rabbit anti TACI antibody (abcam AB 79023; 1:100) detected by goat anti rabbit-antibody PE (Sigma P9757; 1:20).

FIG. 12

Cytotoxic activity of BCMA/CD3 bispecific antibodies as measured in an 18-hour 51-chromium release assay. Effector cells: stimulated enriched human CD8 T cells. Target cells: BCMA-positive human multiple myeloma cell line L363 (i.e. natural expresser). Effector to target cell (E:T) ratio: 10:1.

FIG. 13

Cytotoxic activity of BCMA/CD3 bispecific antibodies as measured in a 48-hour FACS-based cytotoxicity assay. Effector cells: unstimulated human PBMC. Target cells: human multiple myeloma cell line L363 (natural BCMA expresser). Effector to target cell (E:T)-ratio: 10:1.

FIG. 14

Cytotoxic activity of BCMA/CD3 bispecific antibodies as measured in a 48-hour FACS-based cytotoxicity assay. Effector cells: unstimulated human PBMC. Target cells: BCMA-positive human multiple myeloma cell line NCI-H929. Effector to target cell (E:T)-ratio: 10:1.

FIG. 15

Cytotoxic activity of BCMA/CD3 bispecific antibodies as measured in a 48-hour FACS-based cytotoxicity assay. Effector cells: macaque T cell line 4119LnPx. Target cells: CHO cells transfected with macaque BCMA. Effector to target cell (E:T) ratio: 10:1.

FIG. 16:

Anti-tumor activity of a BCMA/CD3 bispecific antibody of epitope cluster E3/E4±E7 in an advanced-stage NCI-H929 xenograft model (see Example A16).

FIG. 17:

FACS-based cytotoxicity assay using human multiple myeloma cell lines NCI-H929, L-363 and OPM-2 as target cells and human PBMC as effector cells (48 h; E:T=10:1). The figure depicts the cytokine levels [pg/ml] which were determined for Il-2, IL-6, IL-10, TNF and IFN-gamma at increasing concentrations of a BCMA/CD3 bispecific antibody of epitope cluster E3/E4±E7 (see Example A22).

EXAMPLES

The following examples illustrate the invention. These examples should not be construed as to limit the scope of this invention. The examples are included for purposes of illustration, and the present invention is limited only by the claims.

Examples A

Example A1

Generation of CHO Cells Expressing Chimeric BCMA

For the construction of the chimeric epitope mapping molecules, the amino acid sequence of the respective epitope domains or the single amino acid residue of human BCMA was changed to the murine sequence. The following molecules were constructed:

Human BCMA ECD/E1 murine (SEQ ID NO: 1009)
Chimeric extracellular BCMA domain: Human extracellular BCMA domain wherein epitope cluster 1 (amino acid residues 1-7 of SEQ ID NO: 1002 or 1007) is replaced by the respective murine cluster (amino acid residues 1-4 of SEQ ID NO: 1004 or 1008)→deletion of amino acid residues 1-3 and G6Q mutation in SEQ ID NO: 1002 or 1007

Human BCMA ECD/E2 murine (SEQ ID NO: 1010)
Chimeric extracellular BCMA domain: Human extracellular BCMA domain wherein epitope cluster 2 (amino acid residues 8-21 of SEQ ID NO: 1002 or 1007) is replaced by the respective murine cluster (amino acid residues 5-18 of SEQ ID NO: 1004 or 1008)→S9F, Q10H, and N11S mutations in SEQ ID NO: 1002 or 1007

Human BCMA ECD/E3 murine (SEQ ID NO: 1011)
Chimeric extracellular BCMA domain: Human extracellular BCMA domain wherein epitope cluster 3 (amino acid residues 24-41 of SEQ ID NO: 1002 or 1007) is replaced by the respective murine cluster (amino acid residues 21-36 of SEQ ID NO: 1004 or 1008)→deletion of amino acid residues 31 and 32 and Q25H, S30N, L35A, and R39P mutation in SEQ ID NO: 1002 or 1007

Human BCMA ECD/E4 murine (SEQ ID NO: 1012)
Chimeric extracellular BCMA domain: Human extracellular BCMA domain wherein epitope cluster 4 (amino acid residues 42-54 of SEQ ID NO: 1002 or 1007) is replaced by the respective murine cluster (amino acid residues 37-49 of SEQ ID NO: 1004 or 1008)→N42D, A43P, N47S, N53Y and A54T mutations in SEQ ID NO: 1002 or 1007

Human BCMA ECD/E5 murine (SEQ ID NO: 1013)
Chimeric extracellular BCMA domain: Human extracellular BCMA domain wherein the amino acid residue at position 22 of SEQ ID NO: 1002 or 1007 (isoleucine) is replaced by its respective murine amino acid residue of SEQ ID NO: 1004 or 1008 (lysine, position 19)→I22K mutation in SEQ ID NO: 1002 or 1007

Human BCMA ECD/E6 murine (SEQ ID NO: 1014)
Chimeric extracellular BCMA domain: Human extracellular BCMA domain wherein the amino acid residue at position 25 of SEQ ID NO: 1002 or 1007 (glutamine) is replaced by its respective murine amino acid residue of SEQ ID NO: 1004 or 1008 (histidine, position 22)→Q25H mutation in SEQ ID NO: 1002 or 1007

Human BCMA ECD/E7 murine (SEQ ID NO: 1015)
Chimeric extracellular BCMA domain: Human extracellular BCMA domain wherein the amino acid residue at position 39 of SEQ ID NO: 1002 or 1007 (arginine) is replaced by its respective murine amino acid residue of SEQ ID NO: 1004 or 1008 (proline, position 34)→R39P mutation in SEQ ID NO: 1002 or 1007

A) The cDNA constructs were cloned into the mammalian expression vector pEF-DHFR and stably transfected into CHO cells. The expression of human BCMA on CHO cells was verified in a FACS assay using a monoclonal anti-human BCMA antibody. Murine BCMA expression was demonstrated with a monoclonal anti-mouse BCMA-antibody. The used concentration of the BCMA antibodies was 10 µg/ml in PBS/2% FCS. Bound monoclonal antibodies were detected with an anti-rat-IgG-Fcy-PE (1:100 in PBS/2% FCS; Jackson-Immuno-Research #112-116-071). As negative control, cells were incubated with PBS/2% FCS instead of the first antibody. The samples were measured by flow cytometry on a FACSCanto II instrument (Becton Dickinson) and analyzed by FlowJo software (Version 7.6). The surface expression of human-murine BCMA chimeras, transfected CHO cells were analyzed and confirmed in a flow cytometry assay with different anti-BCMA antibodies (FIG. 2).

B) For the generation of CHO cells expressing human, macaque, mouse and human/mouse chimeric transmembrane BCMA, the coding sequences of human, macaque, mouse BCMA and the human-mouse BCMA chimeras (BCMA sequences as published in GenBank, accession numbers NM_001192 [human]; NM_011608 [mouse] and XM_001106892 [macaque]) were obtained by gene synthesis according to standard protocols. The gene synthesis fragments were designed as to contain first a Kozak site for eukaryotic expression of the constructs and the coding sequence of a 19 amino acid immunoglobulin leader peptide, followed in frame by the coding sequence of the BCMA proteins respectively in case of the chimeras with the respective epitope domains of the human sequence exchanged for the murine sequence.

Except for the human BCMA ECD/E4 murine and human BCMA constructs the coding sequence of the extracellular domain of the BCMA proteins was followed in frame by the coding sequence of an artificial Ser1-Gly4-Ser1-linker followed by the intracellular domain of human EpCAM (amino acids 226-314; sequence as published in GenBank accession number NM_002354).

All coding sequences were followed by a stop codon. The gene synthesis fragments were also designed as to introduce suitable restriction sites. The gene synthesis fragments were cloned into a plasmid designated pEF-DHFR (pEF-DHFR is described in Raum et al. Cancer Immunol Immunother 50 (2001) 141-150). All aforementioned procedures were carried out according to standard protocols (Sambrook, Molecular Cloning; A Laboratory Manual, 3rd edition, Cold Spring Harbour Laboratory Press, Cold Spring Harbour, N.Y. (2001)). For each antigen a clone with sequence-verified nucleotide sequence was transfected into DHFR deficient CHO cells for eukaryotic expression of the constructs. Eukaryotic protein expression in DHFR deficient CHO cells was performed as described by Kaufman R. J. (1990) Methods Enzymol. 185, 537-566. Gene amplification of the constructs was induced by increasing concentrations of methotrexate (MTX) to a final concentration of up to 20 nM MTX.

Example A2

2.1 Transient Expression in HEK 293 Cells

Clones of the expression plasmids with sequence-verified nucleotide sequences were used for transfection and protein expression in the FreeStyle 293 Expression System (Invitrogen GmbH, Karlsruhe, Germany) according to the manufacturer's protocol. Supernatants containing the expressed proteins were obtained, cells were removed by centrifugation and the supernatants were stored at −20 C.

2.2 Stable Expression in CHO Cells

Clones of the expression plasmids with sequence-verified nucleotide sequences were transfected into DHFR deficient CHO cells for eukaryotic expression of the constructs. Eukaryotic protein expression in DHFR deficient CHO cells was performed as described by Kaufman R. J. (1990) Methods Enzymol. 185, 537-566. Gene amplification of the constructs was induced by increasing concentrations of methotrexate (MTX) to a final concentration of 20 nM MTX. After two passages of stationary culture the cells were grown in roller bottles with nucleoside-free HyQ PF CHO liquid soy medium (with 4.0 mM L-Glutamine with 0.1% Pluronic F—68; HyClone) for 7 days before harvest. The cells were removed by centrifugation and the supernatant containing the expressed protein was stored at −20 C.

2.3 Protein Purification

Purification of soluble BCMA proteins was performed as follows: Äkta® Explorer System (GE Healthcare) and Unicorn® Software were used for chromatography. Immobilized metal affinity chromatography ("IMAC") was performed using a Fractogel EMD Chelate® (Merck) which was loaded with ZnCl2 according to the protocol provided by the manufacturer. The column was equilibrated with buffer A (20 mM sodium phosphate buffer pH 7.2, 0.1 M NaCl) and the filtrated (0.2 μm) cell culture supernatant was applied to the column (10 ml) at a flow rate of 3 ml/min. The column was washed with buffer A to remove unbound sample. Bound protein was eluted using a two-step gradient of buffer B (20 mM sodium phosphate buffer pH 7.2, 0.1 M NaCl, 0.5 M imidazole) according to the following procedure:
  Step 1: 10% buffer B in 6 column volumes
  Step 2: 100% buffer B in 6 column volumes Eluted protein fractions from step 2 were pooled for further purification. All chemicals were of research grade and purchased from Sigma (Deisenhofen) or Merck (Darmstadt).

Gel filtration chromatography was performed on a HiLoad 16/60 Superdex 200 prep grade column (GE/Amersham) equilibrated with Equi-buffer (10 mM citrate, 25 mM lysine-HCl, pH 7.2 for proteins expressed in HEK cells and PBS pH 7.4 for proteins expressed in CHO cells). Eluted protein samples (flow rate 1 ml/min) were subjected to standard SDS-PAGE and Western Blot for detection. Protein concentrations were determined using OD280 nm.

Proteins obtained via transient expression in HEK 293 cells were used for immunizations. Proteins obtained via stable expression in CHO cells were used for selection of binders and for measurement of binding.

Example A3

Epitope Clustering of Murine scFv-Fragments

Cells transfected with human or murine BCMA, or with chimeric BCMA molecules were stained with crude, undiluted periplasmic extract containing scFv binding to human/macaque BCMA. Bound scFv were detected with 1 μg/ml of an anti-FLAG antibody (Sigma F1804) and a R-PE-labeled anti-mouse Fc gamma-specific antibody (1:100; Dianova #115-116-071). All antibodies were diluted in PBS with 2% FCS. As negative control, cells were incubated with PBS/2% FCS instead of the periplasmic extract. The samples were measured by flow cytometry on a FACSCanto II instrument (Becton Dickinson) and analyzed by FlowJo software (Version 7.6).

Example A4

Procurement of Different Recombinant Forms of Soluble Human and Macaque BCMA A) The coding sequences of human and rhesus BCMA (as published in GenBank, accession numbers NM_001192 [human], XM_001106892 [rhesus]) coding sequences of human albumin, human Fcγ1 and murine albumin were used for the construction of artificial cDNA sequences encoding soluble fusion proteins of human and macaque BCMA respectively and human albumin, human IgG1 Fc and murine albumin respectively as well as soluble proteins comprising only the extracellular domains of BCMA. To generate the constructs for expression of the soluble human and macaque BCMA proteins, cDNA fragments were obtained by PCR mutagenesis of the full-length BCMA cDNAs described above and molecular cloning according to standard protocols.

For the fusions with human albumin, the modified cDNA fragments were designed as to contain first a Kozak site for eukaryotic expression of the constructs followed by the coding sequence of the human and rhesus BCMA proteins respectively, comprising amino acids 1 to 54 and 1 to 53 corresponding to the extracellular domain of human and rhesus BCMA, respectively, followed in frame by the coding sequence of an artificial Ser1-Gly4-Ser1-linker, followed in frame by the coding sequence of human serum albumin, followed in frame by the coding sequence of a Flag tag, followed in frame by the coding sequence of a modified histidine tag (SGHHGGHHGGHHH; SEQ ID NO: 1094) and a stop codon.

For the fusions with murine IgG1, the modified cDNA fragments were designed as to contain first a Kozak site for eukaryotic expression of the constructs followed by the coding sequence of the human and macaque BCMA proteins respectively, comprising amino acids 1 to 54 and 1 to 53 corresponding to the extracellular domain of human and rhesus BCMA, respectively, followed in frame by the coding sequence of an artificial Ser1-Gly4-Ser1-linker, followed in frame by the coding sequence of the hinge and Fc gamma portion of human IgG1, followed in frame by the coding sequence of a hexahistidine tag and a stop codon.

For the fusions with murine albumin, the modified cDNA fragments were designed as to contain first a Kozak site for eukaryotic expression of the constructs followed by the coding sequence of the human and macaque BCMA proteins respectively, comprising amino acids 1 to 54 and 1 to 53 corresponding to the extracellular domain of human and rhesus BCMA, respectively, followed in frame by the coding sequence of an artificial Ser1-Gly4-Ser1-linker, followed in frame by the coding sequence of murine serum albumin, followed in frame by the coding sequence of a Flag tag, followed in frame by the coding sequence of a modified histidine tag (SGHHGGHHGGHH; SEQ ID NO: 1094) and a stop codon.

For the soluble extracellular domain constructs, the modified cDNA fragments were designed as to contain first a Kozak site for eukaryotic expression of the constructs followed by the coding sequence of the human and macaque BCMA proteins respectively, comprising amino acids 1 to 54 and 1 to 53 corresponding to the extracellular domain of human and rhesus BCMA, respectively, followed in frame by the coding sequence of an artificial Ser1-Gly1-linker, followed in frame by the coding sequence of a FLAG tag, followed in frame by the coding sequence of a modified histidine tag (SGHHGGHHGGHH; SEQ ID NO: 1094) and a stop codon.

The cDNA fragments were also designed to introduce restriction sites at the beginning and at the end of the fragments. The introduced restriction sites, EcoRI at the 5' end and SalI at the 3' end, were utilized in the following cloning procedures. The cDNA fragments were cloned via EcoRI and SalI into a plasmid designated pEF-DHFR (pEF-DHFR is described in Raum et al. Cancer Immunol Immunother 50 (2001) 141-150). The aforementioned procedures were all carried out according to standard protocols (Sambrook, Molecular Cloning; A Laboratory Manual, 3rd edition, Cold Spring Harbour Laboratory Press, Cold Spring Harbour, N.Y. (2001)).

B) The coding sequences of human and macaque BCMA as described above and coding sequences of human albumin, human Fcγ1, murine Fcγ1, murine Fcγ2a, murine albumin, rat albumin, rat Fcγ1 and rat Fcγ2b were used for the construction of artificial cDNA sequences encoding soluble fusion proteins of human and macaque BCMA respectively and human albumin, human IgG1 Fc, murine IgG1 Fc, murine IgG2a Fc, murine albumin, rat IgG1 Fc, rat IgG2b and rat albumin respectively as well as soluble proteins comprising only the extracellular domains of BCMA. To generate the constructs for expression of the soluble human and macaque BCMA proteins cDNA fragments were obtained by PCR mutagenesis of the full-length BCMA cDNAs described above and molecular cloning according to standard protocols.

For the fusions with albumins the modified cDNA fragments were designed as to contain first a Kozak site for eukaryotic expression of the constructs and the coding sequence of a 19 amino acid immunoglobulin leader peptide, followed in frame by the coding sequence of the extracellular domain of the respective BCMA protein followed in frame by the coding sequence of an artificial Ser1-Gly4-Ser1-linker, followed in frame by the coding sequence of the respective serum albumin, followed in frame by the coding sequence of a Flag tag, followed in frame by the coding sequence of a modified histidine tag (SGHHGGHHGGHH; SEQ ID NO: 1094) and a stop codon.

For the fusions with IgG Fcs the modified cDNA fragments were designed as to contain first a Kozak site for eukaryotic expression of the constructs and the coding sequence of a 19 amino acid immunoglobulin leader peptide, followed in frame by the coding sequence of the extracellular domain of the respective BCMA protein followed in frame by the coding sequence of an artificial Ser1-Gly4-Ser1-linker, except for human IgG1 Fe where an artificial Ser1-Gly1-linker was used, followed in frame by the coding sequence of the hinge and Fc gamma portion of the respective IgG, followed in frame by the coding sequence of a Flag tag, followed in frame by the coding sequence of a modified histidine tag (SGHHGGHHGGHH; SEQ ID NO: 1094) and a stop codon.

For the soluble extracellular domain constructs the modified cDNA fragments were designed as to contain first a Kozak site for eukaryotic expression of the constructs and the coding sequence of a 19 amino acid immunoglobulin leader peptide, followed in frame by the coding sequence of the extracellular domain of the respective BCMA protein followed in frame by the coding sequence of an artificial Ser1-Gly1-linker, followed in frame by the coding sequence of a Flag tag, followed in frame by the coding sequence of a modified histidine tag (SGHHGGHHGGHH; SEQ ID NO: 1094) and a stop codon.

For cloning of the constructs suitable restriction sites were introduced. The cDNA fragments were all cloned into a plasmid designated pEF-DHFR (pEF-DHFR is described in Raum et al. 2001). The aforementioned procedures were all carried out according to standard protocols (Sambrook, 2001).

The following constructs were designed to enable directed panning on distinct epitopes. The coding sequence of murine-human BCMA chimeras and murine-macaque BCMA chimeras (mouse, human and macaque BCMA sequences as described above) and coding sequences of murine albumin and murine Fcγ1 were used for the construction of artificial cDNA sequences encoding soluble fusion proteins of murine-human and murine-macaque BCMA chimeras respectively and murine IgG1 Fc and murine albumin, respectively. To generate the constructs for expression of the soluble murine-human and murine-macaque BCMA chimeras cDNA fragments of murine BCMA (amino acid 1-49) with the respective epitope domains mutated to the human and macaque sequence respectively were obtained by gene synthesis according to standard protocols. Cloning of constructs was carried out as described above and according to standard protocols (Sambrook, 2001).

The following molecules were constructed:
amino acid 1-4 human, murine IgG1 Fc
amino acid 1-4 human, murine albumin
amino acid 1-4 rhesus, murine IgG1 Fc
amino acid 1-4 rhesus, murine albumin
amino acid 5-18 human, murine IgG1 Fc
amino acid 5-18 human, murine albumin
amino acid 5-18 rhesus, murine IgG1 Fc
amino acid 5-18 rhesus, murine albumin
amino acid 37-49 human, murine IgG1 Fc
amino acid 37-49 human, murine albumin
amino acid 37-49 rhesus, murine IgG1 Fc
amino acid 37-49 rhesus, murine albumin Example A5

5.1 Biacore-Based Determination of Bispecific Antibody Affinity to Human and Macaque BCMA and CD3

Biacore analysis experiments were performed using recombinant BCMA fusion proteins with human serum albumin (ALB) to determine BCMA target binding. For CD3 affinity measurements, recombinant fusion proteins having the N-terminal 27 amino acids of the CD3 epsilon (CD3e) fused to human antibody Fc portion were used. This recombinant protein exists in a human CD3e1-27 version and in a cynomolgous CD3e version, both bearing the epitope of the CD3 binder in the bispecific antibodies.

In detail, CM5 Sensor Chips (GE Healthcare) were immobilized with approximately 100 to 150 RU of the respective recombinant antigen using acetate buffer pH4.5 according to the manufacturer's manual. The bispecific antibody samples were loaded in five concentrations: 50 nM, 25 nM, 12.5 nM, 6.25 nM and 3.13 nM diluted in HBS-EP running buffer (GE Healthcare). Flow rate was 30 to 35 µl/min for 3 min, then HBS-EP running buffer was applied for 8 min again at a flow rate of 30 to 35 µl/ml. Regeneration of the chip was performed using 10 mM glycine 0.5 M NaCl pH 2.45. Data sets were analyzed using BiaEval Software (see FIG. A 4). In general two independent experiments were performed.

5.2 Binding Affinity to Human and Macaque BCMA

Binding affinities of BCMA/CD3 bispecific antibodies to human and macaque BCMA were determined by Biacore analysis using recombinant BCMA fusion proteins with mouse albumin (ALB).

In detail, CM5 Sensor Chips (GE Healthcare) were immobilized with approximately 150 to 200 RU of the respective recombinant antigen using acetate buffer pH4.5 according to the manufacturer's manual. The bispecific antibody samples were loaded in five concentrations: 50 nM, 25 nM, 12.5 nM, 6.25 nM and 3.13 nM diluted in HBS-EP running buffer (GE Healthcare). For BCMA affinity determinations the flow rate was 35 µl/min for 3 min, then HBS-EP running buffer was applied for 10, 30 or 60 min again at a flow rate of 35 µl/ml. Regeneration of the chip was performed using a buffer consisting of a 1:1 mixture of 10 mM glycine 0.5 M NaCl pH 1.5 and 6 M guanidine chloride solution. Data sets were analyzed using BiaEval Software (see FIG. A 6). In general two independent experiments were performed.

Confirmative human and macaque CD3 epsilon binding was performed in single experiments using the same concentrations as applied for BCMA binding; off-rate determination was done for 10 min dissociation time.

All BCMA/CD3 bispecific antibodies according to the invention, i.e. those of epitope cluster "E3/E4±E7", showed high affinities to human BCMA in the subnanomolar range. Binding to macaque BCMA was balanced, also showing affinities in the subnanomolar range. Affinities and affinity gaps of BCMA/CD3 bispecific antibodies are shown in Table 2.

TABLE 2

Affinities of BCMA/CD3 bispecific antibodies of the epitope cluster E3/E4 ± E7 to human and macaque BCMA as determined by Biacore analysis, and calculated affinity gaps (ma BCMA:hu BCMA).

| BCMA/CD3 bispecific antibody | hu BCMA [nM] | ma BCMA [nM] | Affinity gap ma BCMA:hu BCMA |
| --- | --- | --- | --- |
| BCMA-24 | 0.11 | 0.18 | 1.6 |
| BCMA-30 | 0.21 | 0.20 | 1:1.1 |
| BCMA-28 | 0.18 | 0.21 | 1.2 |
| BCMA-25 | 0.29 | 0.30 | 1.0 |
| BCMA-27 | 0.25 | 0.12 | 1:2.1 |
| BCMA-31 | 0.24 | 0.35 | 1.5 |
| BCMA-29 | 0.34 | 0.27 | 1:1.3 |
| BCMA-43 | 0.50 | 0.29 | 1:1.7 |
| BCMA-40 | 0.67 | 0.25 | 1:2.7 |
| BCMA-49 | 0.37 | 0.29 | 1:1.3 |
| BCMA-44 | 0.17 | 0.095 | 1:1.8 |
| BCMA-41 | 0.32 | 0.15 | 1:2.1 |
| BCMA-47 | 0.24 | 0.092 | 1:2.6 |
| BCMA-50 | 0.35 | 0.15 | 1:2.3 |
| BCMA-45 | 0.43 | 0.15 | 1:2.9 |
| BCMA-42 | 0.37 | 0.11 | 1:3.4 |
| BCMA-48 | 0.46 | 0.11 | 1:4.2 |
| BCMA-51 | 0.41 | 0.20 | 1:2.1 |

5.3 Biacore-Based Determination of the Bispecific Antibody Affinity to Human and Macaque BCMA The affinities of BCMA/CD3 bispecific antibodies to recombinant soluble BCMA on CM5 chips in Biacore measurements were repeated to reconfirm KDs and especially off-rates using longer dissociation periods (60 min instead of 10 min as used in the previous experiment). All of the tested BCMA/CD3 bispecific antibodies underwent two independent affinity measurements with five different concentrations each.

The affinities of the BCMA/CD3 bispecific antibodies of the epitope cluster E3/E4±E7 were clearly subnanomolar, see examples in Table 3.

TABLE 3

Affinities (KD) of BCMA/CD3 bispecific antibodies of the epitope cluster E3/E4 ± E7 from Biacore experiments using extended dissociation times (two independent experiments each).

| BCMA/CD3 bispecific antibody | KD [nM] human BCMA | KD [nM] macaque BCMA |
| --- | --- | --- |
| BCMA-30 | 0.302 ± 0.074 | 0.284 ± 0.047 |
| BCMA-50 | 0.514 ± 0.005 | 0.196 ± 0.012 |

Example A6

Bispecific Binding and Interspecies Cross-Reactivity

For confirmation of binding to human and macaque BCMA and CD3, bispecific antibodies were tested by flow cytometry using CHO cells transfected with human and macaque BCMA, respectively, the human multiple myeloma cell line NCI-H929 expressing native human BCMA, CD3-expressing human T cell leukemia cell line HPB-ALL (DSMZ, Braunschweig, ACC483) and the CD3-expressing macaque T cell line 4119LnPx (Knappe A, et al., Blood, 2000, 95, 3256-3261). Moreover, untransfected CHO cells were used as negative control.

For flow cytometry 200,000 cells of the respective cell lines were incubated for 30 min on ice with 50 µl of purified bispecific antibody at a concentration of 5 µg/ml. The cells were washed twice in PBS/2% FCS and binding of the constructs was detected with a murine PentaHis antibody (Qiagen; diluted 1:20 in 50 µl PBS/2% FCS). After washing, bound PentaHis antibodies were detected with an Fc gamma-specific antibody (Dianova) conjugated to phycoerythrin, diluted 1:100 in PBS/2% FCS. Samples were measured by flow cytometry on a FACSCanto II instrument and analyzed by FACSDiva software (both from Becton Dickinson).

The BCMA/CD3 bispecific antibodies of epitope cluster E3/E4±E7 stained CHO cells transfected with human and macaque BCMA, the human BCMA-expressing multiple myeloma cell line NCI-H929 as well as human and macaque T cells. Moreover, there was no staining of untransfected CHO cells (see FIG. A 7).

Example A7

Scatchard-Based Determination of Bispecific-Antibody Affinity to Human and Macaque BCMA For Scatchard analysis, saturation binding experiments are performed using a monovalent detection system developed at Micromet (anti-His Fab/Alexa 488) to precisely determine monovalent binding of the bispecific antibodies to the respective cell line. $2 \times 10^4$ cells of the respective cell line (recombinantly human BCMA-expressing CHO cell line, recombinantly macaque BCMA-expressing CHO cell line) are incubated with each 50 µl of a triplet dilution series (eight dilutions at 1:2) of the respective BCMA bispecific antibody starting at 100 nM followed by 16 h incubation at 4° C. under agitation and one residual washing step. Then, the cells are incubated for further 30 min with 30 µl of an anti-His Fab/Alexa488 solution (Micromet; 30 µg/ml). After one washing step, the cells are resuspended in 150 µl FACS buffer containing 3.5% formaldehyde, incubated for further 15 min, centrifuged, resuspended in FACS buffer and analyzed using a FACS Cantoll machine and FACS Diva software. Data are generated from two independent sets of experiments. Values are plotted as hyperbole binding curves. Respective Scatchard analysis is calculated to extrapolate maximal binding (Bmax). The concentrations of bispecific antibodies at half-maximal binding are determined reflecting the respective KDs. Values of triplicate measurements are plotted as hyperbolic curves. Maximal binding is determined using Scatchard evaluation and the respective KDs are calculated.

The affinities of BCMA/CD3 bispecific antibodies to CHO cells transfected with human or macaque BCMA were determined by Scatchard analysis as the most reliable method for measuring potential affinity gaps between human and macaque BCMA.

Cells expressing the BCMA antigen were incubated with increasing concentrations of the respective monomeric BCMA/CD3 bispecific antibody until saturation was reached (16 h). Bound bispecific antibody was detected by flow cytometry. The concentrations of BCMA/CD3 bispecific antibodies at half-maximal binding were determined reflecting the respective KDs.

Values of triplicate measurements were plotted as hyperbolic curves and as S-shaped curves to demonstrate proper concentration ranges from minimal to optimal binding. Maximal binding (Bmax) was determined (FIG. A 8) using Scatchard evaluation and the respective KDs were calculated. Values depicted in Table 4 were derived from two independent experiments per BCMA/CD3 bispecific antibody.

Cell based Scatchard analysis confirmed that the BCMA/CD3 bispecific antibodies of the epitope cluster E3/E4±E7 are subnanomolar in affinity to human BCMA and present with a small interspecies BCMA affinity gap of 1.9-2.9.

Another group of antibodies was identified during epitope clustering (see Examples A1 and A2), which is capable of binding to epitope clusters 1 and 4 of BCMA ("E1/E4"). Epitope cluster 1 is MLQMAGQ (SEQ ID NO: 1018) and epitope cluster 4 is NASVTNSVKGTNA (SEQ ID NO: 1019).

In contrast to the BCMA/CD3 bispecific antibodies of the epitope cluster E3/E4±E7, antibodies of the epitope cluster "E1/E4" show a higher affinity gap between human and macaque BCMA of 3.9-4.5.

TABLE 4

Affinities (KD) of BCMA/CD3 bispecific antibodies of the epitope cluster E3/E4 ± E7 from cell based Scatchard analysis (two independent experiments each) with the calculated affinity gap KD macaque BCMA/KD human BCMA.

| BCMA/CD3 bispecific antibody | KD [nM] human BCMA | KD [nM] macaque BCMA | x-fold KD difference KD ma vs. KD hu BCMA |
|---|---|---|---|
| BCMA-30 | 0.85 ± 0.07 | 2.50 ± 1.12 | 2.9 |
| BCMA-50 | 0.93 ± 0.08 | 1.75 ± 0.62 | 1.9 |

Example A8

Cytotoxic activity 8.1 Chromium Release Assay with Stimulated Human T Cells

Stimulated T cells enriched for CD8+ T cells were obtained as follows: A petri dish (145 mm diameter, Greiner bio-one GmbH, Kremsmünster) was coated with a commercially available anti-CD3 specific antibody (OKT3, Orthoclone) in a final concentration of 1 µg/ml for 1 hour at 37° C. Unbound protein was removed by one washing step with PBS. $3-5 \times 10^7$ human PBMC were added to the precoated petri dish in 120 ml of RPMI 1640 with stabilized glutamine/10% FCS/IL-2 20 U/ml (Proleukin®, Chiron) and stimulated for 2 days. On the third day, the cells were collected and washed once with RPMI 1640. IL-2 was added to a final concentration of 20 U/ml and the cells were cultured again for one day in the same cell culture medium as above. CD8+ cytotoxic T lymphocytes (CTLs) were enriched by depletion of CD4+ T cells and CD56+ NK cells using Dynal-Beads according to the manufacturer's protocol.

Macaque or human BCMA-transfected CHO target cells (BCMA-positive target cells) were washed twice with PBS and labeled with 11.1 MBq $^{51}$Cr in a final volume of 100 µl RPMI with 50% FCS for 60 minutes at 37° C. Subsequently, the labeled target cells were washed 3 times with 5 ml RPMI and then used in the cytotoxicity assay. The assay was performed in a 96-well plate in a total volume of 200 µl supplemented RPMI with an E:T ratio of 10:1. A starting concentration of 0.01-1 µg/ml of purified bispecific antibody and threefold dilutions thereof were used. Incubation time for the assay was 18 hours. Cytotoxicity was determined as relative values of released chromium in the supernatant relative to the difference of maximum lysis (addition of Triton-X) and spontaneous lysis (without effector cells). All measurements were carried out in quadruplicates. Measurement of chromium activity in the supernatants was performed in a Wizard 3" gamma counter (Perkin Elmer Life Sciences GmbH, Köln, Germany). Analysis of the experimental data was carried out with Prism 5 for Windows (version 5.0, GraphPad Software Inc., San Diego, Calif., USA). EC50 values calculated by the analysis program from the sigmoidal dose response curves were used for comparison of cytotoxic activity (see FIG. A 5).

8.2 Potency of Redirecting Stimulated Human Effector T Cells Against Human BCMA-Transfected CHO Cells The cytotoxic activity of BCMA/CD3 bispecific antibodies was analyzed in a 51-chromium ($^{51}$Cr) release cytotoxicity assay using CHO cells transfected with human BCMA as target cells, and stimulated enriched human CD8 T cells as effector cells. The experiment was carried out as described in Example A8.1.

All BCMA/CD3 bispecific antibodies of epitope cluster E3/E4±E7 showed potent cytotoxic activity against human BCMA transfected CHO cells with EC50-values in a range between 1-digit pg/ml and low 2-digit pg/ml (FIG. A9 and Table 5). So the epitope cluster E3/E4±E7 presents with a very favorable epitope-activity relationship supporting very potent bispecific antibody mediated cytotoxic activity.

TABLE 5

EC50 values [pg/ml] of BCMA/CD3 bispecific antibodies antibodies of the epitope cluster E3/E4 ± E7 analyzed in a 51-chromium ($^{51}$Cr) release cytotoxicity assay using CHO cells transfected with human BCMA as target cells, and stimulated enriched human CD8 T cells as effector cells.

| BCMA/CD3 bispecific antibody | EC50 [pg/ml] | R square value |
|---|---|---|
| BCMA-24 | 4.6 | 0.91 |
| BCMA-30 | 6 | 0.83 |
| BCMA-28 | 5.7 | 0.90 |
| BCMA-25 | 9.7 | 0.87 |
| BCMA-27 | 5.4 | 0.90 |
| BCMA-31 | 11 | 0.89 |
| BCMA-29 | 9 | 0.89 |
| BCMA-43 | 12 | 0.74 |
| BCMA-40 | 15 | 0.77 |
| BCMA-49 | 22 | 0.76 |
| BCMA-44 | 13 | 0.78 |
| BCMA-41 | 9.9 | 0.76 |
| BCMA-47 | 8.0 | 0.80 |
| BCMA-50 | 18 | 0.77 |
| BCMA-45 | 14 | 0.81 |
| BCMA-42 | 22 | 0.83 |
| BCMA-48 | 31 | 0.76 |
| BCMA-51 | 30 | 0.83 |

8.3 FACS-Based Cytotoxicity Assay with Unstimulated Human PBMC

Isolation of Effector Cells

Human peripheral blood mononuclear cells (PBMC) were prepared by Ficoll density gradient centrifugation from enriched lymphocyte preparations (buffy coats), a side product of blood banks collecting blood for transfusions. Buffy coats were supplied by a local blood bank and PBMC were prepared on the same day of blood collection. After Ficoll density centrifugation and extensive washes with Dulbecco's PBS (Gibco), remaining erythrocytes were removed from PBMC via incubation with erythrocyte lysis buffer (155 mM $NH_4Cl$, 10 mM $KHCO_3$, 100 μM EDTA). Platelets were removed via the supernatant upon centrifugation of PBMC at 100×g. Remaining lymphocytes mainly encompass B and T lymphocytes, NK cells and monocytes. PBMC were kept in culture at 37° C./5% $CO_2$ in RPMI medium (Gibco) with 10% FCS (Gibco).

Depletion of $CD14^+$ and $CD56^+$ Cells

For depletion of $CD14^+$ cells, human CD14 MicroBeads (Milteny Biotec, MACS, #130-050-201) were used, for depletion of NK cells human CD56 MicroBeads (MACS, #130-050-401). PBMC were counted and centrifuged for 10 min at room temperature with 300×g. The supernatant was discarded and the cell pellet resuspended in MACS isolation buffer [80 μl/$10^7$ cells; PBS (Invitrogen, #20012-043), 0.5% (v/v) FBS (Gibco, #10270-106), 2 mM EDTA (Sigma-Aldrich, #E-6511)]. CD14 MicroBeads and CD56 MicroBeads (20 μl/$10^7$ cells) were added and incubated for 15 min at 4-8° C. The cells were washed with MACS isolation buffer (1-2 ml/$10^7$ cells). After centrifugation (see above), supernatant was discarded and cells resuspended in MACS isolation buffer (500 μl/$10^8$ cells). CD14/CD56 negative cells were then isolated using LS Columns (Miltenyi Biotec, #130-042-401). PBMC w/o CD14+/CD56+ cells were cultured in RPMI complete medium i.e. RPMI1640 (Biochrom AG, #FG1215) supplemented with 10% FBS (Biochrom AG, #S0115), 1× non-essential amino acids (Biochrom AG, #K0293), 10 mM Hepes buffer (Biochrom AG, #L1613), 1 mM sodium pyruvate (Biochrom AG, #L0473) and 100 U/ml penicillin/streptomycin (Biochrom AG, #A2213) at 37° C. in an incubator until needed.

Target Cell Labeling

For the analysis of cell lysis in flow cytometry assays, the fluorescent membrane dye $DiOC_{18}$ (DiO) (Molecular Probes, #V22886) was used to label human BCMA- or macaque BCMA-transfected CHO cells as target cells (human/macaque BCMA-positive target cells) and distinguish them from effector cells. Briefly, cells were harvested, washed once with PBS and adjusted to $10^6$ cells/ml in PBS containing 2% (v/v) FBS and the membrane dye DiO (5 μl/$10^6$ cells). After incubation for 3 min at 37° C., cells were washed twice in complete RPMI medium and the cell number adjusted to $1.25 \times 10^5$ cells/ml. The vitality of cells was determined using 0.5% (v/v) isotonic EosinG solution (Roth, #45380).

Flow Cytometry Based Analysis

This assay was designed to quantify the lysis of macaque or human BCMA-transfected CHO cells (or BCMA positive target cells) in the presence of serial dilutions of BCMA/CD3 bispecific antibodies. Equal volumes of DiO-labeled target cells and effector cells (i.e., PBMC w/o $CD14^+$ cells) were mixed, resulting in an E:T cell ratio of 10:1. 160 μl of this suspension were transferred to each well of a 96-well plate. 40 μl of serial dilutions of the BCMA/CD3 bispecific antibodies and a negative control bispecific antibody (a CD3 based bispecific antibody recognizing an irrelevant target antigen) or RPMI complete medium as an additional negative control were added. The cytotoxic reaction mediated by the BCMA/CD3 bispecific antibodies proceeded for 48 hours in a 7% $CO_2$ humidified incubator. Then cells were transferred to a new 96-well plate, and loss of target cell membrane integrity was monitored by adding propidium iodide (PI) at a final concentration of 1 μg/ml. PI is a membrane impermeable dye that normally is excluded from viable cells, whereas dead cells take it up and become identifiable by fluorescent emission. Samples were measured by flow cytometry on a FACSCanto II instrument and analyzed by FACSDiva software (both from Becton Dickinson). Target cells were identified as DiO-positive cells. PI-negative target cells were classified as living target cells. Percentage of cytotoxicity was calculated according to the following formula:

$$\text{Cytotoxicity } [\%] = n(\text{dead target cells}) \times 100 / n(\text{target cells})$$

n=number of events

Using GraphPad Prism 5 software (Graph Pad Software, San Diego), the percentage of cytotoxicity was plotted against the corresponding bispecific antibody concentrations. Dose response curves were analyzed with the four parametric logistic regression models for evaluation of sigmoid dose response curves with fixed hill slope and EC50 values were calculated.

8.4 Unstimulated Human PBMC Against Human BCMA-Transfected Target Cells

The cytotoxic activity of BCMA/CD3 bispecific antibodies was analyzed in a FACS-based cytotoxicity assay using CHO cells transfected with human BCMA as target cells, and unstimulated human PBMC as effector cells. The assay was carried out as described above (Example A8.3).

The results of the FACS-based cytotoxicity assays with unstimulated human PBMC as effector cells and human BCMA-transfected CHO cells as targets are shown in FIG. A10 and Table 6.

TABLE 6

EC50 values [pg/ml] of BCMA/CD3 bispecific antibodies of epitope cluster E3/E4 ± E7 as measured in a 48-hour FACS-based cytotoxicity assay with unstimulated human PBMC as effector cells and CHO cells transfected with human BCMA as target cells.

| BCMA/CD3 bispecific antibody | EC50 [pg/ml] | R square value |
|---|---|---|
| BCMA-30 | 314 | 0.98 |
| BCMA-50 | 264 | 0.97 |

Example A9

9.1 Exclusion of Cross-Reactivity with BAFF-Receptor

For flow cytometry, 200,000 cells of the respective cell lines were incubated for 30 min on ice with 50 μl of purified bispecific molecules at a concentration of 5 μg/ml. The cells were washed twice in PBS with 2% FCS and binding of the constructs was detected with a murine PentaHis antibody (Qiagen; diluted 1:20 in 50 μl PBS with 2% FCS). After washing, bound PentaHis antibodies were detected with an Fc gamma-specific antibody (Dianova) conjugated to phycoerythrin, diluted 1:100 in PBS with 2% FCS. Samples were measured by flow cytometry on a FACSCanto II instrument and analyzed by FACSDiva software (both from Becton Dickinson).

The bispecific binders were shown to not be cross-reactive with BAFF receptor.

9.2 Exclusion of BCMA/CD3 Bispecific Antibody Cross-Reactivity with Human BAFF-Receptor (BAFF-R) and TACI For exclusion of binding to human BAFF-R and TACI, BCMA/CD3 bispecific antibodies were tested by flow cytometry using CHO cells transfected with human BAFF-R and TACI, respectively. Moreover, L363 multiple myeloma cells were used as positive control for binding to human BCMA. Expression of BAFF-R and TACI antigen on CHO cells was confirmed by two positive control antibodies. Flow cytometry was performed as described in the previous example.

Flow cytometric analysis confirmed that none of the BCMA/CD3 bispecific antibodies of the epitope cluster E3/E4±E7 cross-reacts with human BAFF-R or human TACI (see FIG. A11).

Example A10

Cytotoxic Activity

The potency of human-like BCMA bispecific antibodies in redirecting effector T cells against BCMA-expressing target cells is analyzed in five additional in vitro cytotoxicity assays:
1. The potency of BCMA bispecific antibodies in redirecting stimulated human effector T cells against a BCMA-positive (human) tumor cell line is measured in a 51-chromium release assay.
2. The potency of BCMA bispecific antibodies in redirecting the T cells in unstimulated human PBMC against human BCMA-transfected CHO cells is measured in a FACS-based cytotoxicity assay.
3. The potency of BCMA bispecific antibodies in redirecting the T cells in unstimulated human PBMC against a BCMA-positive (human) tumor cell line is measured in a FACS-based cytotoxicity assay.
4. For confirmation that the cross-reactive BCMA bispecific antibodies are capable of redirecting macaque T cells against macaque BCMA-transfected CHO cells, a FACS-based cytotoxicity assay is performed with a macaque T cell line as effector T cells.
5. The potency gap between monomeric and dimeric forms of BCMA bispecific antibodies is determined in a 51-chromium release assay using human BCMA-transfected CHO cells as target cells and stimulated human T cells as effector cells.

Example A11

Stimulated Human T Cells Against the BCMA-Positive Human Multiple Myeloma Cell Line L363

The cytotoxic activity of BCMA/CD3 bispecific antibodies was analyzed in a 51-chromium ($^{51}$Cr) release cytotoxicity assay using the BCMA-positive human multiple myeloma cell line L363 (DSMZ No. ACC49) as source of target cells, and stimulated enriched human CD8 T cells as effector cells. The assay was carried out as described in Example A8.1.

In accordance with the results of the 51-chromium release assays with stimulated enriched human CD8 T lymphocytes as effector cells and human BCMA-transfected CHO cells as targets, BCMA/CD3 bispecific antibodies of epitope cluster E3/E4±E7 are potent in cytotoxic activity (FIG. A12 and Table 7).

Unexpectedly, however, BCMA/CD3 bispecific antibodies of epitope cluster E1/E4—although potent in cytotoxic activity against CHO cell transfected with human BCMA—proved to be rather weakly cytotoxic against the human multiple myeloma cell line L363 expressing native BCMA at low density on the cell surface (FIG. A12 and Table 7). Without wishing to be bound by theory, the inventors believe that the E1/E4 epitope of human BCMA might be less well accessible on natural BCMA expressers than on BCMA-transfected cells.

TABLE 7

EC50 values [pg/ml] of BCMA/CD3 bispecific antibodies of epitope clusters E1/E4 (rows 1 and 2) and E3/E4 ± E7 (rows 3 and 4) analyzed in an 18-hour 51-chromium ($^{51}$Cr) release cytotoxicity assay with the BCMA-positive human multiple myeloma cell line L363 as source of target cells, and stimulated enriched human CD8 T cells as effector cells.

| | BCMA/CD3 bispecific antibody | EC50 [pg/ml] | R square value |
|---|---|---|---|
| 1 | BCMA-54 | 685 | 0.84 |
| 2 | BCMA-53 | 1107 | 0.82 |
| 3 | BCMA-30 | 182 | 0.83 |
| 4 | BCMA-50 | 148 | 0.83 |

Example A12

Unstimulated Human PBMC Against the BCMA-Positive Human Multiple Myeloma Cell Line L363

The cytotoxic activity of BCMA/CD3 bispecific antibodies was furthermore analyzed in a FACS-based cytotoxicity assay using the BCMA-positive human multiple myeloma cell line L363 (DSMZ, ACC49)—showing the weakest surface expression of native BCMA of all tested target T cell lines—as source of target cells and unstimulated human PBMC as effector cells. The assay was carried out as described above (Example A8.3).

As observed in the 51-chromium release assay with stimulated enriched human CD8 T lymphocytes against the human multiple myeloma cell line L363, the BCMA/CD3 bispecific antibodies of epitope cluster E1/E4—in contrast to their potent cytotoxic activity against CHO cell transfected with human BCMA—proved to be again less potent in redirecting the cytotoxic activity of unstimulated PBMC against the human multiple myeloma cell line L363 expressing native BCMA at low density on the cell surface. This is in line with the theory provided hereinabove, i.e., the E1/E4 epitope of human BCMA may be less well accessible on natural BCMA expressers than on BCMA-transfected cells. BCMA/CD3 bispecific antibodies of the epitope cluster E3/E4±E7 presented with 3-digit pg/ml EC50-values in this assay (see FIG. A13 and Table 8).

TABLE 8

EC50 values [pg/ml] of BCMA/CD3 bispecific antibodies of epitope clusters E1/E4 (rows 1 and 2) and E3/E4 ± E7 (rows 3 and 4) as measured in a 48-hour FACS-based cytotoxicity assay with unstimulated human PBMC as effector cells and the human multiple myeloma cell line L363 as source of target cells.

|   | BCMA/CD3 bispecific antibody | EC50 [pg/ml] | R square value |
|---|---|---|---|
| 1 | BCMA-54 | 3162 | 0.99 |
| 2 | BCMA-53 | 2284 | 0.98 |
| 3 | BCMA-30 | 589 | 0.99 |
| 4 | BCMA-50 | 305 | 0.99 |

Expectedly, EC50-values were higher in cytotoxicity assays with unstimulated PBMC as effector cells than in cytotoxicity assays using enriched stimulated human CD8 T cells.

Example A13

Unstimulated Human PBMC Against the BCMA-Positive Human Multiple Myeloma Cell Line NCI-H929

The cytotoxic activity of BCMA/CD3 bispecific antibodies was analyzed in a FACS-based cytotoxicity assay using the BCMA-positive human multiple myeloma cell line NCI-H929 (ATCC CRL-9068) as source of target cells and unstimulated human PBMC as effector cells. The assay was carried out as described above (Example A8.3).

The results of this assay with another human multiple myeloma cell line (i.e. NCI-H929) expressing native BCMA on the cell surface confirm those obtained with human multiple myeloma cell line L363. Again, BCMA/CD3 bispecific antibodies of epitope cluster E1/E4—in contrast to their potent cytotoxic activity against CHO cell transfected with human BCMA—proved to be less potent in redirecting the cytotoxic activity of unstimulated PBMC against human multiple myeloma cells confirming the theory that the E1/E4 epitope of human BCMA may be less well accessible on natural BCMA expressers than on BCMA-transfected cells. Such an activity gap between BCMA-transfected target cells and natural expressers as seen for the E1/E4 binders was not found for the E3/E4±E7 binders. BCMA/CD3 bispecific antibodies of the epitope cluster E3/E4±E7 presented with 2-digit pg/ml EC50-values and hence redirected unstimulated PBMC against NCI-H929 target cells with surprisingly good EC50-values (see FIG. A14 and Table 9).

TABLE 9

EC50 values [pg/ml] of BCMA/CD3 bispecific antibodies of epitope clusters E1/E4 (rows 1 and 2) and E3/E4 ± E7 (rows 3 and 4) as measured in a 48-hour FACS-based cytotoxicity assay with unstimulated human PBMC as effector cells and the human multiple myeloma cell line NCI-H929 as source of target cells.

|   | BCMA/CD3 bispecific antibody | EC50 [pg/ml] | R square value |
|---|---|---|---|
| 1 | BCMA-54 | 2604 | 0.99 |
| 2 | BCMA-53 | 2474 | 0.99 |
| 3 | BCMA-30 | 38.0 | 0.95 |
| 4 | BCMA-50 | 40.4 | 0.97 |

As expected, EC50-values were lower with the human multiple myeloma cell line NCI-H929, which expresses higher levels of BCMA on the cell surface compared to L363.

Example A14

Macaque T Cells Against Macaque BCMA-Expressing Target Cells

Finally, the cytotoxic activity of BCMA/CD3 bispecific antibodies was analyzed in a FACS-based cytotoxicity assay using CHO cells transfected with macaque BCMA as target cells, and a macaque T cell line as source of effector cells.

The macaque T cell line 4119LnPx (Knappe et al. Blood 95:3256-61 (2000)) was used as source of effector cells. Target cell labeling of macaque BCMA-transfected CHO cells and flow cytometry based analysis of cytotoxic activity was performed as described above.

Macaque T cells from cell line 4119LnPx were induced to efficiently kill macaque BCMA-transfected CHO cells by BCMA/CD3 bispecific antibodies of epitope cluster E3/E4±E7. The antibodies presented very potently with 1-digit pg/ml EC50-values in this assay, confirming that these antibodies are very active in the macaque system. On the other hand, BCMA/CD3 bispecific antibodies of the epitope cluster E1/E4 showed a significantly weaker potency with EC50-values in the 2-digit to 3-digit pg/ml range (see FIG. A15 and Table 10). The E3/E4±E7 specific antibodies are hence about 20 to over 100 times more potent in the macaque system.

TABLE 10

EC50 values [pg/ml] of BCMA/CD3 bispecific antibodies of epitope clusters E1/E4 (rows 1 and 2) and E3/E4 ± E7 (rows 3 and 4) as measured in a 48-hour FACS-based cytotoxicity assay with macaque T cell line 4119LnPx as effector cells and CHO cells transfected with macaque BCMA as target cells.

|   | BCMA/CD3 bispecific antibody | EC50 [pg/ml] | R square value |
|---|---|---|---|
| 1 | BCMA-54 | 78.5 | 0.98 |
| 2 | BCMA-53 | 183 | 0.96 |
| 3 | BCMA-30 | 1.7 | 0.97 |
| 4 | BCMA-50 | 3.7 | 0.96 |

Example A15

Potency Gap Between BCMA/CD3 Bispecific Antibody Monomer and Dimer

In order to determine the difference in cytotoxic activity between the monomeric and the dimeric isoform of individual BCMA/CD3 bispecific antibodies (referred to as potency gap), a 51-chromium release cytotoxicity assay as described hereinabove (Example A8.1) was carried out with purified BCMA/CD3 bispecific antibody monomer and dimer. The potency gap was calculated as ratio between EC50 values of the bispecific antibody's monomer and dimer. Potency gaps of the tested BCMA/CD3 bispecific antibodies of the epitope cluster E3/E4±E7 were between 0.2 and 1.2. There is hence no substantially more active dimer compared to its respective monomer.

Example A16

Monomer to Dimer Conversion after Three Freeze/Thaw Cycles

Bispecific BCMA/CD3 antibody monomer were subjected to three freeze/thaw cycles followed by high performance SEC to determine the percentage of initially monomeric antibody, which had been converted into antibody dimer.

15 μg of monomeric antibody were adjusted to a concentration of 250 μg/ml with generic buffer and then frozen at −80° C. for 30 min followed by thawing for 30 min at room temperature. After three freeze/thaw cycles the dimer content was determined by HP-SEC. To this end, 15 μg aliquots of the monomeric isoforms of the antibodies were thawed and equalized to a concentration of 250 μg/ml in the original SEC buffer (10 mM citric acid—75 mM lysine HCl—4% trehalose—pH 7.2) followed by incubation at 37° C. for 7 days. A high resolution SEC Column TSK Gel G3000 SWXL (Tosoh, Tokyo-Japan) was connected to an Akta Purifier 10 FPLC (GE Lifesciences) equipped with an A905 Autosampler. Column equilibration and running buffer consisted of 100 mM KH2PO4-200 mM Na2SO4 adjusted to pH 6.6. After 7 days of incubation, the antibody solution (15 μg protein) was applied to the equilibrated column and elution was carried out at a flow rate of 0.75 ml/min at a maximum pressure of 7 MPa. The whole run was monitored at 280, 254 and 210 nm optical absorbance. Analysis was done by peak integration of the 210 nm signal recorded in the Akta Unicorn software run evaluation sheet. Dimer content was calculated by dividing the area of the dimer peak by the total area of monomer plus dimer peak.

The BCMA/CD3 bispecific antibodies of the epitope cluster E3/E4±E7 presented with dimer percentages of 0.8 to 1.5% after three freeze/thaw cycles, which is considered good. However, the dimer conversion rates of BCMA/CD3 bispecific antibodies of the epitope cluster E1/E4 reached unfavorably high values, exceeding the threshold to disadvantageous dimer values of ≥2.5% (4.7% and 3.8%, respectively), see Table 11.

TABLE 11

Percentage of monomeric versus dimeric BCMA/CD3 bispecific antibodies of epitope clusters E1/E4 (rows 1 and 2) and E3/E4 ± E7 (rows 3 and 4) after three freeze/thaw cycles as determined by High Performance Size Exclusion Chromatography (HP-SEC).

| | BCMA/CD3 bispecific antibody | Monomer [%] | Dimer [%] |
|---|---|---|---|
| 1 | BCMA-54 | 95.3 | 4.7 |
| 2 | BCMA-53 | 96.2 | 3.8 |
| 3 | BCMA-30 | 98.5 | 1.5 |
| 4 | BCMA-50 | 99.2 | 0.8 |

Example A17

Thermostability

Temperature melting curves were determined by Differential Scanning calorimetry (DSC) to determine intrinsic biophysical protein stabilities of the BCMA/CD3 bispecific antibodies. These experiments were performed using a MicroCal LLC (Northampton, Mass., U.S.A) VP-DSC device. The energy uptake of a sample containing BCMA/CD3 bispecific antibody was recorded from 20 to 90° C. compared to a sample which just contained the antibody's formulation buffer.

In detail, BCMA/CD3 bispecific antibodies were adjusted to a final concentration of 250 μg/ml in storage buffer. 300 μl of the prepared protein solutions were transferred into a deep well plate and placed into the cooled autosampler rack position of the DSC device. Additional wells were filled with the SEC running buffer as reference material for the measurement. For the measurement process the protein solution was transferred by the autosampler into a capillary. An additional capillary was filled with the SEC running buffer as reference. Heating and recording of required heating energy to heat up both capillaries at equal temperature ranging from 20 to 90° C. was done for all samples.

For recording of the respective melting curve, the overall sample temperature was increased stepwise. At each temperature T energy uptake of the sample and the formulation buffer reference was recorded. The difference in energy uptake Cp (kcal/mole/° C.) of the sample minus the reference was plotted against the respective temperature. The melting temperature is defined as the temperature at the first maximum of energy uptake.

All tested BCMA/CD3 bispecific antibodies of the epitope cluster E3/E4±E7 showed favorable thermostability with melting temperatures above 60° C., more precisely between 62° C. and 63° C.

Example A18

Exclusion of Plasma Interference by Flow Cytometry

To determine potential interaction of BCMA/CD3 bispecific antibodies with human plasma proteins, a plasma interference test was established. To this end, 10 μg/ml of the respective BCMA/CD3 bispecific antibodies were incubated for one hour at 37° C. in 90% human plasma. Subsequently, the binding to human BCMA expressing CHO cells was determined by flow cytometry.

For flow cytometry, 200,000 cells of the respective cell lines were incubated for 30 min on ice with 50 μl of purified antibody at a concentration of 5 μg/ml. The cells were washed twice in PBS/2% FCS and binding of the constructs was detected with a murine PentaHis antibody (Qiagen; diluted 1:20 in 50 μl PBS/2% FCS). After washing, bound PentaHis antibodies were detected with an Fc gamma-specific antibody (Dianova) conjugated to phycoerythrin, diluted 1:100 in PBS/2% FCS. Samples were measured by flow cytometry on a FACSCanto II instrument and analyzed by FACSDiva software (both from Becton Dickinson).

The obtained data were compared with a control assay using PBS instead of human plasma. Relative binding was calculated as follows:

(signal PBS sample/signal w/o detection agent)/(signal plasma sample/signal w/o detection agent).

In this experiment it became obvious that there was no significant reduction of target binding of the respective BCMA/CD3 bispecific antibodies of the epitope cluster E3/E4±E7 mediated by plasma proteins. The relative plasma interference value was between 1.28±0.38 and 1.29±0.31 (with a value of "2" being considered as lower threshold for interference signals).

Example A19

Therapeutic Efficacy of BCMA/CD3 Bispecific Antibodies in Human Tumor Xenograft Models On day 1 of the study, $5 \times 10^6$ cells of the human cancer cell line NCI-H929 were subcutaneously injected in the right dorsal flank of female NOD/SCID mice.

On day 9, when the mean tumor volume had reached about 100 mm³, in vitro expanded human CD3⁺ T cells were transplanted into the mice by injection of about $2 \times 10^7$ cells into the peritoneal cavity of the animals. Mice of vehicle control group 1 (n=5) did not receive effector cells and were used as an untransplanted control for comparison with vehicle control group 2 (n=10, receiving effector cells) to monitor the impact of T cells alone on tumor growth.

The antibody treatment started on day 13, when the mean tumor volume had reached about 200 mm$^3$. The mean tumor size of each treatment group on the day of treatment start was not statistically different from any other group (analysis of variance). Mice were treated with 0.5 mg/kg/day of the BCMA/CD3 bispecific antibody BCMA-50×CD3 (group 3, n=8) by intravenous bolus injection for 17 days.

Tumors were measured by caliper during the study and progress evaluated by intergroup comparison of tumor volumes (TV). The tumor growth inhibition T/C [%] was determined by calculating TV as T/C %=100× (median TV of analyzed group)/(median TV of control group 2).

Figure 16:
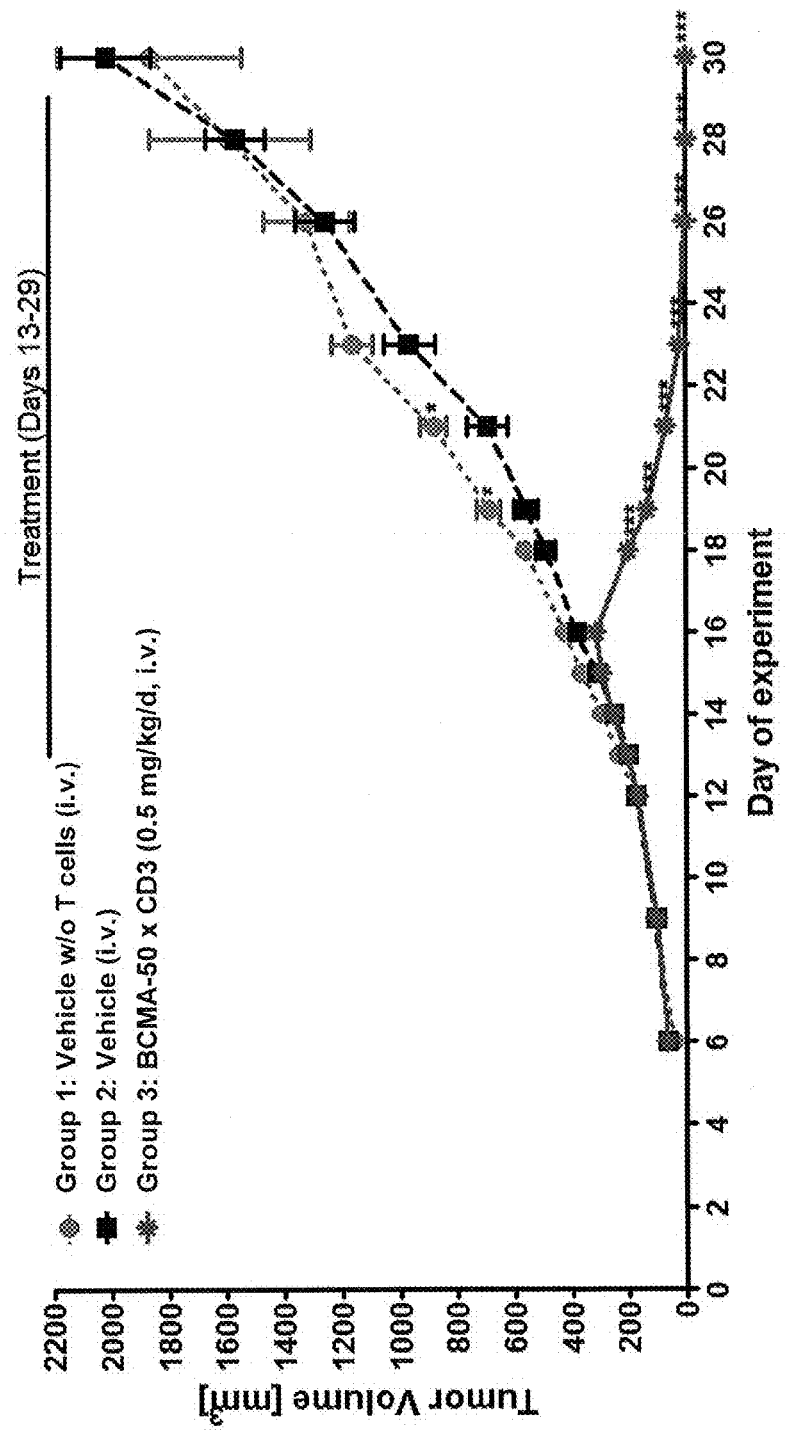

The results are shown in Table 12 and FIG. 16.

TABLE 12

Median tumor volume (TV) and tumor growth inhibition (T/C) at days 13 to 30.

| Dose group | Data | d13 | d14 | d15 | d16 | d18 | d19 | d21 | d23 | d26 | d28 | d30 |
|---|---|---|---|---|---|---|---|---|---|---|---|---|
| 1 Vehi. control w/o T cells | med.TV [mm$^3$] | 238 | 288 | 395 | 425 | 543 | 632 | 863 | 1067 | 1116 | 1396 | 2023 |
| | T/C [%] | 120 | 123 | 127 | 118 | 104 | 114 | 122 | 113 | 87 | 85 | 110 |
| 2 Vehicle control | med.TV [mm$^3$] | 198 | 235 | 310 | 361 | 525 | 553 | 706 | 942 | 1290 | 1636 | 1839 |
| | T/C [%] | 100 | 100 | 100 | 100 | 100 | 100 | 100 | 100 | 100 | 100 | 100 |
| 3 BCMA-50 | med.TV [mm$^3$] | 215 | 260 | 306 | 309 | 192 | 131 | 64.1 | 0.0 | 0.0 | 0.0 | 0.0 |
| | T/C [%] | 108 | 111 | 98.6 | 85.7 | 36.5 | 23.7 | 9.1 | 0.0 | 0.0 | 0.0 | 0.0 |

Example A20

Exclusion of Lysis of Target Negative Cells

An in vitro lysis assay was carried out using the BCMA-positive human multiple myeloma cell line NCI-H929 and purified T cells at an effector to target cell ratio of 5:1 and with an incubation time of 24 hours. The BCMA/CD3 bispecific antibody of epitope cluster E3/E4±E7 (BCMA-50) showed high potency and efficacy in the lysis of NCI-H929. However, no lysis was detected in the BCMA negative cell lines HL60 (AML/myeloblast morphology), MES-SA (uterus sarcoma, fibroblast morphology), and SNU-16 (stomach carcinoma, epithelial morphology) for up to 500 nM of the antibody.

Example A21

Induction of T Cell Activation of Different PBMC Subsets

A FACS-based cytotoxicity assay (48 h; E:T=10:1) was carried out using human multiple myeloma cell lines NCI-H929, L-363 and OPM-2 as target cells and different subsets of human PBMC (CD4$^+$/CD8$^+$/CD25$^+$/CD69$^+$) as effector cells. The results (see Table 13) show that the degree of activation, as measured by the EC$_{50}$ value, is essentially in the same range for the different analyzed PBMC subsets.

TABLE 13

EC50 values [ng/ml] of the BCMA/CD3 bispecific antibody BCMA-50 of epitope cluster E3/E4 ± E7 as measured in a 48-hour FACS-based cytotoxicity assay with different subsets of human PBMC as effector cells and different human multiple myeloma cell lines as target cells.

| Cell line | PBMC | EC$_{50}$ [ng/ml] BCMA-50 x CD3 |
|---|---|---|
| NCI-H929 | CD4$^+$/CD25$^+$ | 0.88 |
| | CD8$^+$/CD25$^+$ | 0.38 |
| | CD4$^+$/CD69$^+$ | 0.41 |
| | CD8$^+$/CD69$^+$ | 0.15 |
| OPM-2 | CD4$^+$/CD25$^+$ | 5.06 |
| | CD8$^+$/CD25$^+$ | 1.51 |
| | CD4$^+$/CD69$^+$ | 3.52 |
| | CD8$^+$/CD69$^+$ | 0.68 |

TABLE 13-continued

EC50 values [ng/ml] of the BCMA/CD3 bispecific antibody BCMA-50 of epitope cluster E3/E4 ± E7 as measured in a 48-hour FACS-based cytotoxicity assay with different subsets of human PBMC as effector cells and different human multiple myeloma cell lines as target cells.

| Cell line | PBMC | EC$_{50}$ [ng/ml] BCMA-50 x CD3 |
|---|---|---|
| L-363 | CD4$^+$/CD25$^+$ | 0.72 |
| | CD8$^+$/CD25$^+$ | 0.38 |
| | CD4$^+$/CD69$^+$ | 0.53 |
| | CD8$^+$/CD69$^+$ | 0.12 |

Example A22

Induction of Cytokine Release

Figure 17:
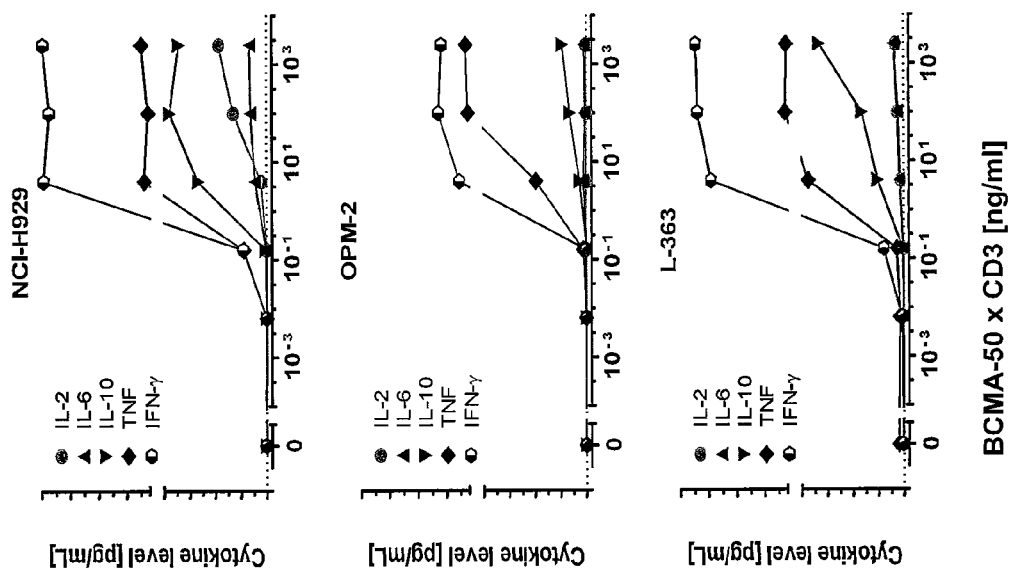

A FACS-based cytotoxicity assay (48 h; E:T=10:1) was carried out using human multiple myeloma cell lines NCI-H929, L-363 and OPM-2 as target cells and human PBMC as effector cells. The levels of cytokine release [pg/ml] were determined at increasing concentrations of a BCMA/CD3 bispecific antibody of epitope cluster E3/E4±E7. The following cytokines were analyzed: Il-2, IL-6, IL-10, TNF and IFN-gamma. The results are shown in Table 14 and FIG. 17.

TABLE 14

Release of IL-2, IL-6, IL-10, TNF and IFN-gamma [pg/ml] induced by 2.5 µg/ml of a BCMA/CD3 bispecific antibody of epitope cluster E3/E4 ± E7 (BCMA-50) in a 48-hour FACS-based cytotoxicity assay with human PBMC as effector cells and different human multiple myeloma cell lines as target cells (E:T = 10:1).

| Cell line | Cytokine levels [pg/ml] | | | | |
|---|---|---|---|---|---|
| | IL-2 | IL-6 | IL-10 | TNF | IFN-gamma |
| NCI-H929 | 1865 | 664 | 3439 | 9878 | 79372 |
| OPM-2 | 23 | 99 | 942 | 6276 | 23568 |
| L-363 | 336 | 406 | 3328 | 4867 | 69687 |

Examples B

Example B1

Generation of CHO Cells Expressing Chimeric BCMA

For the construction of the chimeric epitope mapping molecules, the amino acid sequence of the respective epitope domains or the single amino acid residue of human BCMA was changed to the murine sequence. The following molecules were constructed:

Human BCMA ECD/E1 murine (SEQ ID NO: 1009)
Chimeric extracellular BCMA domain: Human extracellular BCMA domain wherein epitope cluster 1 (amino acid residues 1-7 of SEQ ID NO: 1002 or 1007) is replaced by the respective murine cluster (amino acid residues 1-4 of SEQ ID NO: 1004 or 1008)→deletion of amino acid residues 1-3 and G6Q mutation in SEQ ID NO: 1002 or 1007

Human BCMA ECD/E2 murine (SEQ ID NO: 1010)
Chimeric extracellular BCMA domain: Human extracellular BCMA domain wherein epitope cluster 2 (amino acid residues 8-21 of SEQ ID NO: 1002 or 1007) is replaced by the respective murine cluster (amino acid residues 5-18 of SEQ ID NO: 1004 or 1008)→S9F, Q10H, and N11S mutations in SEQ ID NO: 1002 or 1007

Human BCMA ECD/E3 murine (SEQ ID NO: 1011)
Chimeric extracellular BCMA domain: Human extracellular BCMA domain wherein epitope cluster 3 (amino acid residues 24-41 of SEQ ID NO: 1002 or 1007) is replaced by the respective murine cluster (amino acid residues 21-36 of SEQ ID NO: 1004 or 1008)→deletion of amino acid residues 31 and 32 and Q25H, S30N, L35A, and R39P mutation in SEQ ID NO: 1002 or 1007

Human BCMA ECD/E4 murine (SEQ ID NO: 1012)
Chimeric extracellular BCMA domain: Human extracellular BCMA domain wherein epitope cluster 4 (amino acid residues 42-54 of SEQ ID NO: 1002 or 1007) is replaced by the respective murine cluster (amino acid residues 37-49 of SEQ ID NO: 1004 or 1008)→N42D, A43P, N47S, N53Y and A54T mutations in SEQ ID NO: 1002 or 1007

Human BCMA ECD/E5 murine (SEQ ID NO: 1013)
Chimeric extracellular BCMA domain: Human extracellular BCMA domain wherein the amino acid residue at position 22 of SEQ ID NO: 1002 or 1007 (isoleucine) is replaced by its respective murine amino acid residue of SEQ ID NO: 1004 or 1008 (lysine, position 19)→I22K mutation in SEQ ID NO: 1002 or 1007

Human BCMA ECD/E6 murine (SEQ ID NO: 1014)
Chimeric extracellular BCMA domain: Human extracellular BCMA domain wherein the amino acid residue at position 25 of SEQ ID NO: 1002 or 1007 (glutamine) is replaced by its respective murine amino acid residue of SEQ ID NO: 1004 or 1008 (histidine, position 22)→Q25H mutation in SEQ ID NO: 1002 or 1007

Human BCMA ECD/E7 murine (SEQ ID NO: 1015)
Chimeric extracellular BCMA domain: Human extracellular BCMA domain wherein the amino acid residue at position 39 of SEQ ID NO: 1002 or 1007 (arginine) is replaced by its respective murine amino acid residue of SEQ ID NO: 1004 or 1008 (proline, position 34)→R39P mutation in SEQ ID NO: 1002 or 1007

The cDNA constructs were cloned into the mammalian expression vector pEF-DHFR and stably transfected into CHO cells. The expression of human BCMA on CHO cells was verified in a FACS assay using a monoclonal anti-human BCMA antibody. Murine BCMA expression was demonstrated with a monoclonal anti-mouse BCMA-antibody. The used concentration of the BCMA antibodies was 10 µg/ml in PBS/2% FCS. Bound monoclonal antibodies were detected with an anti-rat-IgG-Fcy-PE (1:100 in PBS/2% FCS; Jackson-Immuno-Research #112-116-071). As negative control, cells were incubated with PBS/2% FCS instead of the first antibody. The samples were measured by flow cytometry on a FACSCanto II instrument (Becton Dickinson) and analyzed by FlowJo software (Version 7.6). The surface expression of human-murine BCMA chimeras, transfected CHO cells were analyzed and confirmed in a flow cytometry assay with different anti-BCMA antibodies (FIG. 2).

Example B2

2.1 Transient Expression in HEK 293 Cells

Clones of the expression plasmids with sequence-verified nucleotide sequences were used for transfection and protein expression in the FreeStyle 293 Expression System (Invitrogen GmbH, Karlsruhe, Germany) according to the manufacturer's protocol. Supernatants containing the expressed proteins were obtained, cells were removed by centrifugation and the supernatants were stored at −20 C.

2.2 Stable Expression in CHO Cells

Clones of the expression plasmids with sequence-verified nucleotide sequences were transfected into DHFR deficient CHO cells for eukaryotic expression of the constructs. Eukaryotic protein expression in DHFR deficient CHO cells was performed as described by Kaufman R. J. (1990) Methods Enzymol. 185, 537-566. Gene amplification of the constructs was induced by increasing concentrations of methotrexate (MTX) to a final concentration of 20 nM MTX. After two passages of stationary culture the cells were grown in roller bottles with nucleoside-free HyQ PF CHO liquid soy medium (with 4.0 mM L-Glutamine with 0.1% Pluronic F—68; HyClone) for 7 days before harvest. The cells were removed by centrifugation and the supernatant containing the expressed protein was stored at −20 C.

Example B3

Epitope Clustering of Murine scFv-Fragments

Cells transfected with human or murine BCMA, or with chimeric BCMA molecules were stained with crude, undiluted periplasmic extract containing scFv binding to human/macaque BCMA. Bound scFv were detected with 1 µg/ml of an anti-FLAG antibody (Sigma F1804) and a R-PE-labeled anti-mouse Fc gamma-specific antibody (1:100; Dianova

115-116-071). All antibodies were diluted in PBS with 2% FCS. As negative control, cells were incubated with PBS/2% FCS instead of the periplasmic extract. The samples were measured by flow cytometry on a FACSCanto II instrument (Becton Dickinson) and analyzed by FlowJo software (Version 7.6).

Example B4

Procurement of Different Recombinant Forms of Soluble Human and Macaque BCMA

The coding sequences of human and rhesus BCMA (as published in GenBank, accession numbers NM_001192 [human], XM_001106892 [rhesus]) coding sequences of human albumin, human Fcγ1 and murine albumin were used for the construction of artificial cDNA sequences encoding soluble fusion proteins of human and macaque BCMA respectively and human albumin, human IgG1 Fc and murine albumin respectively as well as soluble proteins comprising only the extracellular domains of BCMA. To generate the constructs for expression of the soluble human and macaque BCMA proteins, cDNA fragments were obtained by PCR mutagenesis of the full-length BCMA cDNAs described above and molecular cloning according to standard protocols.

For the fusions with human albumin, the modified cDNA fragments were designed as to contain first a Kozak site for eukaryotic expression of the constructs followed by the coding sequence of the human and rhesus BCMA proteins respectively, comprising amino acids 1 to 54 and 1 to 53 corresponding to the extracellular domain of human and rhesus BCMA, respectively, followed in frame by the coding sequence of an artificial Ser1-Gly4-Ser1-linker, followed in frame by the coding sequence of human serum albumin, followed in frame by the coding sequence of a Flag tag, followed in frame by the coding sequence of a modified histidine tag (SGHHGGHHGGHH; SEQ ID NO: 1094) and a stop codon.

For the fusions with murine IgG1, the modified cDNA fragments were designed as to contain first a Kozak site for eukaryotic expression of the constructs followed by the coding sequence of the human and macaque BCMA proteins respectively, comprising amino acids 1 to 54 and 1 to 53 corresponding to the extracellular domain of human and rhesus BCMA, respectively, followed in frame by the coding sequence of an artificial Ser1-Gly4-Ser1-linker, followed in frame by the coding sequence of the hinge and Fc gamma portion of human IgG1, followed in frame by the coding sequence of a hexahistidine tag and a stop codon.

For the fusions with murine albumin, the modified cDNA fragments were designed as to contain first a Kozak site for eukaryotic expression of the constructs followed by the coding sequence of the human and macaque BCMA proteins respectively, comprising amino acids 1 to 54 and 1 to 53 corresponding to the extracellular domain of human and rhesus BCMA, respectively, followed in frame by the coding sequence of an artificial Ser1-Gly4-Ser1-linker, followed in frame by the coding sequence of murine serum albumin, followed in frame by the coding sequence of a Flag tag, followed in frame by the coding sequence of a modified histidine tag (SGHHGGHHGGHH; SEQ ID NO: 1094) and a stop codon.

For the soluble extracellular domain constructs, the modified cDNA fragments were designed as to contain first a Kozak site for eukaryotic expression of the constructs followed by the coding sequence of the human and macaque BCMA proteins respectively, comprising amino acids 1 to 54 and 1 to 53 corresponding to the extracellular domain of human and rhesus BCMA, respectively, followed in frame by the coding sequence of an artificial Ser1-Gly1-linker, followed in frame by the coding sequence of a Flag tag, followed in frame by the coding sequence of a modified histidine tag (SGHHGGHHGGHH; SEQ ID NO: 1094) and a stop codon.

The cDNA fragments were also designed to introduce restriction sites at the beginning and at the end of the fragments. The introduced restriction sites, EcoRI at the 5' end and SalI at the 3' end, were utilized in the following cloning procedures. The cDNA fragments were cloned via EcoRI and SalI into a plasmid designated pEF-DHFR (pEF-DHFR is described in Raum et al. Cancer Immunol Immunother 50 (2001) 141-150). The aforementioned procedures were all carried out according to standard protocols (Sambrook, Molecular Cloning; A Laboratory Manual, 3rd edition, Cold Spring Harbour Laboratory Press, Cold Spring Harbour, N.Y. (2001)).

Example B5

Biacore-Based Determination of Bispecific Antibody Affinity to Human and Macaque BCMA and CD3

Biacore analysis experiments were performed using recombinant BCMA fusion proteins with human serum albumin (ALB) to determine BCMA target binding. For CD3 affinity measurements, recombinant fusion proteins having the N-terminal 27 amino acids of the CD3 epsilon (CD3e) fused to human antibody Fc portion were used. This recombinant protein exists in a human CD3e1-27 version and in a cynomolgous CD3e version, both bearing the epitope of the CD3 binder in the bispecific antibodies.

In detail, CM5 Sensor Chips (GE Healthcare) were immobilized with approximately 100 to 150 RU of the respective recombinant antigen using acetate buffer pH4.5 according to the manufacturer's manual. The bispecific antibody samples were loaded in five concentrations: 50 nM, 25 nM, 12.5 nM, 6.25 nM and 3.13 nM diluted in HBS-EP running buffer (GE Healthcare). Flow rate was 30 to 35 µl/min for 3 min, then HBS-EP running buffer was applied for 8 min again at a flow rate of 30 to 35 µl/ml. Regeneration of the chip was performed using 10 mM glycine 0.5 M NaCl pH 2.45. Data sets were analyzed using BiaEval Software. In general two independent experiments were performed.

Example B6

Flow Cytometry Analysis

Functionality and binding strength of affinity matured scFv molecules were analyzed in FACS using human and macaque BCMA transfected CHO cells. In brief, approximately $10^5$ cells were incubated with 50 µl of serial 1:3 dilutions of periplasmatic E. coli cell extracts for 50 min on ice. After washing with PBS/10% FCS/0.05% sodium azide, the cells were incubated with 30 µl of Flag-M2 IgG (Sigma, 1:900 in PBS/10% FCS/0.05% sodium azide) for 40 min on ice. After a second wash, the cells were incubated with 30 µl of a R-Phycoerythrin (PE)-labeled goat anti-mouse IgG (Jackson ImmunoResearch, 1:100 in PBS/10% FCS/0.05% sodium azide) for 40 min on ice. The cells were then washed again and resuspended in 200 µl PBS/10% FCS/0.05% sodium azide. The relative fluorescence of stained cells was measured using a FACSCanto™ flow cytometer (BD). The results are depicted as FACS histograms, plotting the log of fluorescence intensity versus relative cell number (see FIG. B4).

Example B7

Bispecific Binding and Interspecies Cross-Reactivity

For flow cytometry, 200,000 cells of the respective cell lines were incubated for 30 min on ice with 50 µl of purified bispecific molecules at a concentration of 5 µg/ml. The cells were washed twice in PBS with 2% FCS and binding of the constructs was detected with a murine PentaHis antibody (Qiagen; diluted 1:20 in 50 µl PBS with 2% FCS). After washing, bound PentaHis antibodies were detected with an Fc gamma-specific antibody (Dianova) conjugated to phycoerythrin, diluted 1:100 in PBS with 2% FCS.

Example B8

Scatchard-Based Determination of Bispecific-Antibody Affinity to Human and Macaque BCMA For Scatchard analysis, saturation binding experiments are performed using a monovalent detection system developed at Micromet (anti-His Fab/Alexa 488) to precisely determine monovalent binding of the bispecific antibodies to the respective cell line.

$2 \times 10^4$ cells of the respective cell line (recombinantly human BCMA-expressing CHO cell line, recombinantly macaque BCMA-expressing CHO cell line) are incubated with each 50 µl of a triplet dilution series (eight dilutions at 1:2) of the respective BCMA bispecific antibody starting at 100 nM followed by 16 h incubation at 4° C. under agitation and one residual washing step. Then, the cells are incubated for further 30 min with 30 µl of an anti-His Fab/Alexa488 solution (Micromet; 30 µg/ml). After one washing step, the cells are resuspended in 150 µl FACS buffer containing 3.5% formaldehyde, incubated for further 15 min, centrifuged, resuspended in FACS buffer and analyzed using a FACS Cantoll machine and FACS Diva software. Data are generated from two independent sets of experiments. Values are plotted as hyperbole binding curves. Respective Scatchard analysis is calculated to extrapolate maximal binding (Bmax). The concentrations of bispecific antibodies at half-maximal binding are determined reflecting the respective KDs. Values of triplicate measurements are plotted as hyperbolic curves. Maximal binding is determined using Scatchard evaluation and the respective KDs are calculated.

Example B9

Cytotoxic Activity 9.1 Chromium Release Assay with Stimulated Human T Cells

Stimulated T cells enriched for CD8+ T cells were obtained as described below.

A petri dish (145 mm diameter, Greiner bio-one GmbH, Kremsmünster) was coated with a commercially available anti-CD3 specific antibody (OKT3, Orthoclone) in a final concentration of 1 µg/ml for 1 hour at 37° C. Unbound protein was removed by one washing step with PBS. 3-5×10$^7$ human PBMC were added to the precoated petri dish in 120 ml of RPMI 1640 with stabilized glutamine/10% FCS/IL-2 20 U/ml (Proleukin®, Chiron) and stimulated for 2 days. On the third day, the cells were collected and washed once with RPMI 1640. IL-2 was added to a final concentration of 20 U/ml and the cells were cultured again for one day in the same cell culture medium as above.

CD8+ cytotoxic T lymphocytes (CTLs) were enriched by depletion of CD4+ T cells and CD56+ NK cells using DynalBeads according to the manufacturer's protocol.

Macaque or human BCMA-transfected CHO target cells were washed twice with PBS and labeled with 11.1 MBq $^{51}$Cr in a final volume of 100 µl RPMI with 50% FCS for 60 minutes at 37° C. Subsequently, the labeled target cells were washed 3 times with 5 ml RPMI and then used in the cytotoxicity assay. The assay was performed in a 96-well plate in a total volume of 200 µl supplemented RPMI with an E:T ratio of 10:1. A starting concentration of 0.01-1 µg/ml of purified bispecific antibody and threefold dilutions thereof were used. Incubation time for the assay was 18 hours. Cytotoxicity was determined as relative values of released chromium in the supernatant relative to the difference of maximum lysis (addition of Triton-X) and spontaneous lysis (without effector cells). All measurements were carried out in quadruplicates. Measurement of chromium activity in the supernatants was performed in a Wizard 3" gammacounter (Perkin Elmer Life Sciences GmbH, Köln, Germany). Analysis of the results was carried out with Prism 5 for Windows (version 5.0, GraphPad Software Inc., San Diego, Calif., USA). EC50 values calculated by the analysis program from the sigmoidal dose response curves were used for comparison of cytotoxic activity.

9.2 FACS-Based Cytotoxicity Assay with Unstimulated Human PBMC

Isolation of Effector Cells

Human peripheral blood mononuclear cells (PBMC) were prepared by Ficoll density gradient centrifugation from enriched lymphocyte preparations (buffy coats), a side product of blood banks collecting blood for transfusions. Buffy coats were supplied by a local blood bank and PBMC were prepared on the same day of blood collection. After Ficoll density centrifugation and extensive washes with Dulbecco's PBS (Gibco), remaining erythrocytes were removed from PBMC via incubation with erythrocyte lysis buffer (155 mM $NH_4Cl$, 10 mM $KHCO_3$, 100 µM EDTA). Platelets were removed via the supernatant upon centrifugation of PBMC at 100×g. Remaining lymphocytes mainly encompass B and T lymphocytes, NK cells and monocytes. PBMC were kept in culture at 37° C./5% $CO_2$ in RPMI medium (Gibco) with 10% FCS (Gibco).

Depletion of CD14+ and CD56+ Cells

For depletion of CD14+ cells, human CD14 MicroBeads (Milteny Biotec, MACS, #130-050-201) were used, for depletion of NK cells human CD56 MicroBeads (MACS, #130-050-401). PBMC were counted and centrifuged for 10 min at room temperature with 300×g. The supernatant was discarded and the cell pellet resuspended in MACS isolation buffer [80 µL/10$^7$ cells; PBS (Invitrogen, #20012-043), 0.5% (v/v) FBS (Gibco, #10270-106), 2 mM EDTA (Sigma-Aldrich, #E-6511)]. CD14 MicroBeads and CD56 MicroBeads (20 µL/10$^7$ cells) were added and incubated for 15 min at 4-8° C. The cells were washed with MACS isolation buffer (1-2 mL/10$^7$ cells). After centrifugation (see above), supernatant was discarded and cells resuspended in MACS isolation buffer (500 µL/10$^8$ cells). CD14/CD56 negative cells were then isolated using LS Columns (Miltenyi Biotec, #130-042-401). PBMC w/o CD14+/CD56+ cells were cultured in RPMI complete medium i.e. RPMI1640 (Biochrom AG, #FG1215)

supplemented with 10% FBS (Biochrom AG, #S0115), 1× non-essential amino acids (Biochrom AG, #K0293), 10 mM Hepes buffer (Biochrom AG, #L1613), 1 mM sodium pyruvate (Biochrom AG, #L0473) and 100 U/mL penicillin/streptomycin (Biochrom AG, #A2213) at 37° C. in an incubator until needed.

Target Cell Labeling

For the analysis of cell lysis in flow cytometry assays, the fluorescent membrane dye $DiOC_{18}$ (DiO) (Molecular Probes, #V22886) was used to label human BCMA- or macaque BCMA-transfected CHO cells as target cells and distinguish them from effector cells. Briefly, cells were harvested, washed once with PBS and adjusted to $10^6$ cell/mL in PBS containing 2% (v/v) FBS and the membrane dye DiO (5 µL/$10^6$ cells). After incubation for 3 min at 37° C., cells were washed twice in complete RPMI medium and the cell number adjusted to $1.25 \times 10^5$ cells/mL. The vitality of cells was determined using 0.5% (v/v) isotonic EosinG solution (Roth, #45380).

Flow Cytometry Based Analysis

This assay was designed to quantify the lysis of macaque or human BCMA-transfected CHO cells in the presence of serial dilutions of BCMA bispecific antibodies.

Equal volumes of DiO-labeled target cells and effector cells (i.e., PBMC w/o $CD14^+$ cells) were mixed, resulting in an E:T cell ratio of 10:1. 160 µL of this suspension were transferred to each well of a 96-well plate. 40 µL of serial dilutions of the BCMA bispecific antibodies and a negative control bispecific (an CD3-based bispecific antibody recognizing an irrelevant target antigen) or RPMI complete medium as an additional negative control were added. The bispecific antibody-mediated cytotoxic reaction proceeded for 48 hours in a 7% $CO_2$ humidified incubator. Then cells were transferred to a new 96-well plate and loss of target cell membrane integrity was monitored by adding propidium iodide (PI) at a final concentration of 1 µg/mL. PI is a membrane impermeable dye that normally is excluded from viable cells, whereas dead cells take it up and become identifiable by fluorescent emission.

Samples were measured by flow cytometry on a FACSCanto II instrument and analyzed by FACSDiva software (both from Becton Dickinson).

Target cells were identified as DiO-positive cells. PI-negative target cells were classified as living target cells. Percentage of cytotoxicity was calculated according to the following formula:

$$\text{Cytotoxicity [\%]} = \frac{n_{dead\ target\ cells}}{n_{target\ cells}} \times 100$$

$n$ = number of events

Using GraphPad Prism 5 software (Graph Pad Software, San Diego), the percentage of cytotoxicity was plotted against the corresponding bispecific antibody concentrations. Dose response curves were analyzed with the four parametric logistic regression models for evaluation of sigmoid dose response curves with fixed hill slope and EC50 values were calculated.

Example B10

Exclusion of Cross-Reactivity with BAFF-Receptor

For flow cytometry, 200,000 cells of the respective cell lines were incubated for 30 min on ice with 50 µl of purified bispecific molecules at a concentration of 5 µg/ml. The cells were washed twice in PBS with 2% FCS and binding of the constructs was detected with a murine PentaHis antibody (Qiagen; diluted 1:20 in 50 µl PBS with 2% FCS). After washing, bound PentaHis antibodies were detected with an Fc gamma-specific antibody (Dianova) conjugated to phycoerythrin, diluted 1:100 in PBS with 2% FCS. Samples were measured by flow cytometry on a FACSCanto II instrument and analyzed by FACSDiva software (both from Becton Dickinson). The bispecific binders were shown to not be cross-reactive with BAFF receptor.

Example B11

Cytotoxic Activity

The potency of human-like BCMAbispecific antibodies in redirecting effector T cells against BCMA-expressing target cells is analyzed in five additional in vitro cytotoxicity assays:

1. The potency of BCMA bispecific antibodies in redirecting stimulated human effector T cells against a BCMA-positive (human) tumor cell line is measured in a 51-chromium release assay.

2. The potency of BCMA bispecific antibodies in redirecting the T cells in unstimulated human PBMC against human BCMA-transfected CHO cells is measured in a FACS-based cytotoxicity assay.

3. The potency of BCMA bispecific antibodies in redirecting the T cells in unstimulated human PBMC against a BCMA-positive (human) tumor cell line is measured in a FACS-based cytotoxicity assay.

4. For confirmation that the cross-reactive BCMA bispecific antibodies are capable of redirecting macaque T cells against macaque BCMA-transfected CHO cells, a FACS-based cytotoxicity assay is performed with a macaque T cell line as effector T cells.

5. The potency gap between monomeric and dimeric forms of BCMA bispecific antibodies is determined in a 51-chromium release assay using human BCMA-transfected CHO cells as target cells and stimulated human T cells as effector cells.

Examples C

Example C1

Generation of CHO Cells Expressing Chimeric BCMA

For the construction of the chimeric epitope mapping molecules, the amino acid sequence of the respective epitope domains or the single amino acid residue of human BCMA was changed to the murine sequence. The following molecules were constructed:

Human BCMA ECD/E1 murine (SEQ ID NO: 1009)

Chimeric extracellular BCMA domain: Human extracellular BCMA domain wherein epitope cluster 1 (amino acid residues 1-7 of SEQ ID NO: 1002 or 1007) is replaced by the respective murine cluster (amino acid residues 1-4 of SEQ ID NO: 1004 or 1008)→deletion of amino acid residues 1-3 and G6Q mutation in SEQ ID NO: 1002 or 1007

Human BCMA ECD/E2 murine (SEQ ID NO: 1010)

Chimeric extracellular BCMA domain: Human extracellular BCMA domain wherein epitope cluster 2 (amino acid residues 8-21 of SEQ ID NO: 1002 or 1007) is replaced by the respective murine cluster (amino acid residues 5-18 of SEQ ID NO: 1004 or 1008)→S9F, Q10H, and N115 mutations in SEQ ID NO: 1002 or 1007

Human BCMA ECD/E3 murine (SEQ ID NO: 1011)

Chimeric extracellular BCMA domain: Human extracellular BCMA domain wherein epitope cluster 3 (amino acid residues 24-41 of SEQ ID NO: 1002 or 1007) is replaced by the respective murine cluster (amino acid residues 21-36 of SEQ ID NO: 1004 or 1008)→deletion of amino acid residues 31 and 32 and Q25H, S30N, L35A, and R39P mutation in SEQ ID NO: 1002 or 1007

Human BCMA ECD/E4 murine (SEQ ID NO: 1012)

Chimeric extracellular BCMA domain: Human extracellular BCMA domain wherein epitope cluster 4 (amino acid residues 42-54 of SEQ ID NO: 1002 or 1007) is replaced by the respective murine cluster (amino acid residues 37-49 of SEQ ID NO: 1004 or 1008)→N42D, A43P, N47S, N53Y and A54T mutations in SEQ ID NO: 1002 or 1007

Human BCMA ECD/E5 murine (SEQ ID NO: 1013)

Chimeric extracellular BCMA domain: Human extracellular BCMA domain wherein the amino acid residue at position 22 of SEQ ID NO: 1002 or 1007 (isoleucine) is replaced by its respective murine amino acid residue of SEQ ID NO: 1004 or 1008 (lysine, position 19)→I22K mutation in SEQ ID NO: 1002 or 1007

Human BCMA ECD/E6 murine (SEQ ID NO: 1014)

Chimeric extracellular BCMA domain: Human extracellular BCMA domain wherein the amino acid residue at position 25 of SEQ ID NO: 1002 or 1007 (glutamine) is replaced by its respective murine amino acid residue of SEQ ID NO: 1004 or 1008 (histidine, position 22)→Q25H mutation in SEQ ID NO: 1002 or 1007

Human BCMA ECD/E7 murine (SEQ ID NO: 1015)

Chimeric extracellular BCMA domain: Human extracellular BCMA domain wherein the amino acid residue at position 39 of SEQ ID NO: 1002 or 1007 (arginine) is replaced by its respective murine amino acid residue of SEQ ID NO: 1004 or 1008 (proline, position 34)→R39P mutation in SEQ ID NO: 1002 or 1007

The cDNA constructs were cloned into the mammalian expression vector pEF-DHFR and stably transfected into CHO cells. The expression of human BCMA on CHO cells was verified in a FACS assay using a monoclonal anti-human BCMA antibody. Murine BCMA expression was demonstrated with a monoclonal anti-mouse BCMA-antibody. The used concentration of the BCMA antibodies was 10 µg/ml in PBS/2% FCS. Bound monoclonal antibodies were detected with an anti-rat-IgG-Fcy-PE (1:100 in PBS/2% FCS; Jackson-Immuno-Research #112-116-071). As negative control, cells were incubated with PBS/2% FCS instead of the first antibody. The samples were measured by flow cytometry on a FACSCanto II instrument (Becton Dickinson) and analyzed by FlowJo software (Version 7.6). The surface expression of human-murine BCMA chimeras, transfected CHO cells were analyzed and confirmed in a flow cytometry assay with different anti-BCMA antibodies (FIG. 2).

Example C2

2.1 Transient Expression in HEK 293 Cells

Clones of the expression plasmids with sequence-verified nucleotide sequences were used for transfection and protein expression in the FreeStyle 293 Expression System (Invitrogen GmbH, Karlsruhe, Germany) according to the manufacturer's protocol. Supernatants containing the expressed proteins were obtained, cells were removed by centrifugation and the supernatants were stored at −20 C.

2.2 Stable Expression in CHO Cells

Clones of the expression plasmids with sequence-verified nucleotide sequences were transfected into DHFR deficient CHO cells for eukaryotic expression of the constructs. Eukaryotic protein expression in DHFR deficient CHO cells was performed as described by Kaufman R. J. (1990) Methods Enzymol. 185, 537-566. Gene amplification of the constructs was induced by increasing concentrations of methotrexate (MTX) to a final concentration of 20 nM MTX. After two passages of stationary culture the cells were grown in roller bottles with nucleoside-free HyQ PF CHO liquid soy medium (with 4.0 mM L-Glutamine with 0.1% Pluronic F-68; HyClone) for 7 days before harvest. The cells were removed by centrifugation and the supernatant containing the expressed protein was stored at −20 C.

Example C3

Epitope Clustering of Murine scFv-Fragments

Cells transfected with human or murine BCMA, or with chimeric BCMA molecules were stained with crude, undiluted periplasmic extract containing scFv binding to human/ macaque BCMA. Bound scFv were detected with 1 µg/ml of an anti-FLAG antibody (Sigma F1804) and a R-PE-labeled anti-mouse Fc gamma-specific antibody (1:100; Dianova #115-116-071). All antibodies were diluted in PBS with 2% FCS. As negative control, cells were incubated with PBS/2% FCS instead of the periplasmic extract. The samples were measured by flow cytometry on a FACSCanto II instrument (Becton Dickinson) and analyzed by FlowJo software (Version 7.6).

Example C4

Procurement of Different Recombinant Forms of Soluble Human and Macaque BCMA

The coding sequences of human and rhesus BCMA (as published in GenBank, accession numbers NM_001192 [human], XM_001106892 [rhesus]) coding sequences of human albumin, human Fcγ1 and murine albumin were used for the construction of artificial cDNA sequences encoding soluble fusion proteins of human and macaque BCMA respectively and human albumin, human IgG1 Fc and murine albumin respectively as well as soluble proteins comprising only the extracellular domains of BCMA. To generate the constructs for expression of the soluble human and macaque BCMA proteins, cDNA fragments were obtained by PCR mutagenesis of the full-length BCMA cDNAs described above and molecular cloning according to standard protocols.

For the fusions with human albumin, the modified cDNA fragments were designed as to contain first a Kozak site for eukaryotic expression of the constructs followed by the coding sequence of the human and rhesus BCMA proteins respectively, comprising amino acids 1 to 54 and 1 to 53 corresponding to the extracellular domain of human and rhesus BCMA, respectively, followed in frame by the coding sequence of an artificial Ser1-Gly4-Ser1-linker, followed in frame by the coding sequence of human serum albumin, followed in frame by the coding sequence of a Flag tag, followed in frame by the coding sequence of a modified histidine tag (SGHHGGHHGGHH; SEQ ID NO: 1094) and a stop codon.

For the fusions with murine IgG1, the modified cDNA fragments were designed as to contain first a Kozak site for eukaryotic expression of the constructs followed by the coding sequence of the human and macaque BCMA proteins respectively, comprising amino acids 1 to 54 and 1 to 53 corresponding to the extracellular domain of human and rhesus BCMA, respectively, followed in frame by the coding sequence of an artificial Ser1-Gly4-Ser1-linker, followed in frame by the coding sequence of the hinge and Fc gamma portion of human IgG1, followed in frame by the coding sequence of a hexahistidine tag and a stop codon.

For the fusions with murine albumin, the modified cDNA fragments were designed as to contain first a Kozak site for eukaryotic expression of the constructs followed by the coding sequence of the human and macaque BCMA proteins respectively, comprising amino acids 1 to 54 and 1 to 53 corresponding to the extracellular domain of human and rhesus BCMA, respectively, followed in frame by the coding sequence of an artificial Ser1-Gly4-Ser1-linker, followed in frame by the coding sequence of murine serum albumin, followed in frame by the coding sequence of a Flag tag, followed in frame by the coding sequence of a modified histidine tag (SGHHGGHHGGHH; SEQ ID NO: 1094) and a stop codon.

For the soluble extracellular domain constructs, the modified cDNA fragments were designed as to contain first a Kozak site for eukaryotic expression of the constructs followed by the coding sequence of the human and macaque BCMA proteins respectively, comprising amino acids 1 to 54 and 1 to 53 corresponding to the extracellular domain of human and rhesus BCMA, respectively, followed in frame by the coding sequence of an artificial Ser1-Gly1-linker, followed in frame by the coding sequence of a Flag tag, followed in frame by the coding sequence of a modified histidine tag (SGHHGGHHGGHH; SEQ ID NO: 1094) and a stop codon.

The cDNA fragments were also designed to introduce restriction sites at the beginning and at the end of the fragments. The introduced restriction sites, EcoRI at the 5' end and SalI at the 3' end, were utilized in the following cloning procedures. The cDNA fragments were cloned via EcoRI and SalI into a plasmid designated pEF-DHFR (pEF-DHFR is described in Raum et al. Cancer Immunol Immunother 50 (2001) 141-150). The aforementioned procedures were all carried out according to standard protocols (Sambrook, Molecular Cloning; A Laboratory Manual, 3rd edition, Cold Spring Harbour Laboratory Press, Cold Spring Harbour, N.Y. (2001)).

Example C5

Biacore-Based Determination of Bispecific Antibody Affinity to Human and Macaque BCMA and CD3

Biacore analysis experiments are performed using recombinant BCMA fusion proteins with human serum albumin (ALB) to determine BCMA target binding. For CD3 affinity measurements, recombinant fusion proteins having the N-terminal 27 amino acids of the CD3 epsilon (CD3e) fused to human antibody Fc portion are used. This recombinant protein exists in a human CD3e1-27 version and in a cynomolgous CD3e version, both bearing the epitope of the CD3 binder in the bispecific antibodies.

In detail, CM5 Sensor Chips (GE Healthcare) are immobilized with approximately 100 to 150 RU of the respective recombinant antigen using acetate buffer pH4.5 according to the manufacturer's manual. The bispecific antibody samples are loaded in five concentrations: 50 nM, 25 nM, 12.5 nM, 6.25 nM and 3.13 nM diluted in HBS-EP running buffer (GE Healthcare). Flow rate is 30 to 35 µl/min for 3 min, then HBS-EP running buffer is applied for 8 min again at a flow rate of 30 to 35 µl/ml. Regeneration of the chip is performed using 10 mM glycine 0.5 M NaCl pH 2.45. Data sets are analyzed using BiaEval Software. In general two independent experiments were performed.

Example C6

Flow Cytometry Analysis

Functionality and binding strength of affinity matured scFv molecules were analyzed in FACS using human and macaque BCMA transfected CHO cells. In brief, approximately $10^5$ cells were incubated with 50 µl of serial 1:3 dilutions of periplasmatic E. coli cell extracts for 50 min on ice. After washing with PBS/10% FCS/0.05% sodium azide, the cells were incubated with 30 µl of Flag-M2 IgG (Sigma, 1:900 in PBS/10% FCS/0.05% sodium azide) for 40 min on ice. After a second wash, the cells were incubated with 30 µl of a R-Phycoerythrin (PE)-labeled goat anti-mouse IgG (Jackson ImmunoResearch, 1:100 in PBS/10% FCS/0.05% sodium azide) for 40 min on ice. The cells were then washed again and resuspended in 200 µl PBS/10% FCS/0.05% sodium azide. The relative fluorescence of stained cells was measured using a FACSCanto™ flow cytometer (BD). The results are depicted as FACS histograms, plotting the log of fluorescence intensity versus relative cell number (see FIG. C4).

Example C7

Bispecific Binding and Interspecies Cross-Reactivity

For flow cytometry, 200,000 cells of the respective cell lines were incubated for 30 min on ice with 50 µl of purified bispecific molecules at a concentration of 5 µg/ml. The cells were washed twice in PBS with 2% FCS and binding of the constructs was detected with a murine PentaHis antibody (Qiagen; diluted 1:20 in 50 µl PBS with 2% FCS). After washing, bound PentaHis antibodies were detected with an Fc gamma-specific antibody (Dianova) conjugated to phycoerythrin, diluted 1:100 in PBS with 2% FCS.

Example C8

Scatchard-Based Determination of Bispecific-Antibody Affinity to Human and Macaque BCMA For Scatchard analysis, saturation binding experiments are performed using a monovalent detection system developed at Micromet (anti-His Fab/Alexa 488) to precisely determine monovalent binding of the bispecific antibodies to the respective cell line.

$2 \times 10^4$ cells of the respective cell line (recombinantly human BCMA-expressing CHO cell line, recombinantly macaque BCMA-expressing CHO cell line) are incubated with each 50 µl of a triplet dilution series (eight dilutions at 1:2) of the respective BCMA bispecific antibody starting at 100 nM followed by 16 h incubation at 4° C. under agitation and one residual washing step. Then, the cells are incubated for further 30 min with 30 µl of an anti-His Fab/Alexa488 solution (Micromet; 30 µg/ml). After one washing step, the cells are resuspended in 150 µl FACS buffer containing 3.5% formaldehyde, incubated for further 15 min, centrifuged, resuspended in FACS buffer and analyzed using a FACS Cantoll machine and FACS Diva software. Data are generated from two independent sets of experiments. Values are plotted as hyperbole binding curves. Respective Scatchard analysis is calculated to extrapolate maximal binding (Bmax). The concentrations of bispecific antibodies at half-maximal binding are determined reflecting the respective KDs. Values of triplicate measurements are plotted as hyperbolic curves. Maximal binding is determined using Scatchard evaluation and the respective KDs are calculated.

Example C9

Cytotoxic Activity 9.1 Chromium Release Assay with Stimulated Human T Cells

Stimulated T cells enriched for CD8$^+$ T cells were obtained as described below.

A petri dish (145 mm diameter, Greiner bio-one GmbH, Kremsmünster) was coated with a commercially available anti-CD3 specific antibody (OKT3, Orthoclone) in a final concentration of 1 µg/ml for 1 hour at 37° C. Unbound protein was removed by one washing step with PBS. 3-5×10$^7$ human PBMC were added to the precoated petri dish in 120 ml of RPMI 1640 with stabilized glutamine/10% FCS/IL-2 20 U/ml (Proleukin®, Chiron) and stimulated for 2 days. On the third day, the cells were collected and washed once with RPMI 1640. IL-2 was added to a final concentration of 20 U/ml and the cells were cultured again for one day in the same cell culture medium as above.

CD8$^+$ cytotoxic T lymphocytes (CTLs) were enriched by depletion of CD4$^+$ T cells and CD56$^+$ NK cells using DynalBeads according to the manufacturer's protocol.

Macaque or human BCMA-transfected CHO target cells were washed twice with PBS and labeled with 11.1 MBq $^{51}$Cr in a final volume of 100 µl RPMI with 50% FCS for 60 minutes at 37° C. Subsequently, the labeled target cells were washed 3 times with 5 ml RPMI and then used in the cytotoxicity assay. The assay was performed in a 96-well plate in a total volume of 200 µl supplemented RPMI with an E:T ratio of 10:1. A starting concentration of 0.01-1 µg/ml of purified bispecific antibody and threefold dilutions thereof were used. Incubation time for the assay was 18 hours. Cytotoxicity was determined as relative values of released chromium in the supernatant relative to the difference of maximum lysis (addition of Triton-X) and spontaneous lysis (without effector cells). All measurements were carried out in quadruplicates. Measurement of chromium activity in the supernatants was performed in a Wizard 3" gammacounter (Perkin Elmer Life Sciences GmbH, Köln, Germany). Analysis of the results was carried out with Prism 5 for Windows (version 5.0, GraphPad Software Inc., San Diego, Calif., USA). EC50 values calculated by the analysis program from the sigmoidal dose response curves were used for comparison of cytotoxic activity.

9.2 FACS-Based Cytotoxicity Assay with Unstimulated Human PBMC

Isolation of Effector Cells

Human peripheral blood mononuclear cells (PBMC) were prepared by Ficoll density gradient centrifugation from enriched lymphocyte preparations (buffy coats), a side product of blood banks collecting blood for transfusions. Buffy coats were supplied by a local blood bank and PBMC were prepared on the same day of blood collection. After Ficoll density centrifugation and extensive washes with Dulbecco's PBS (Gibco), remaining erythrocytes were removed from PBMC via incubation with erythrocyte lysis buffer (155 mM NH$_4$Cl, 10 mM KHCO$_3$, 100 µM EDTA). Platelets were removed via the supernatant upon centrifugation of PBMC at 100×g. Remaining lymphocytes mainly encompass B and T lymphocytes, NK cells and monocytes. PBMC were kept in culture at 37° C./5% CO$_2$ in RPMI medium (Gibco) with 10% FCS (Gibco).

Depletion of CD14$^+$ and CD56$^+$ Cells

For depletion of CD14$^+$ cells, human CD14 MicroBeads (Milteny Biotec, MACS, #130-050-201) were used, for depletion of NK cells human CD56 MicroBeads (MACS, #130-050-401). PBMC were counted and centrifuged for 10 min at room temperature with 300×g. The supernatant was discarded and the cell pellet resuspended in MACS isolation buffer [80 µL/10$^7$ cells; PBS (Invitrogen, #20012-043), 0.5% (v/v) FBS (Gibco, #10270-106), 2 mM EDTA (Sigma-Aldrich, #E-6511)]. CD14 MicroBeads and CD56 MicroBeads (20 µL/10$^7$ cells) were added and incubated for 15 min at 4-8° C. The cells were washed with MACS isolation buffer (1-2 mL/10$^7$ cells). After centrifugation (see above), supernatant was discarded and cells resuspended in MACS isolation buffer (500 µL/10$^8$ cells). CD14/CD56 negative cells were then isolated using LS Columns (Miltenyi Biotec, #130-042-401). PBMC w/o CD14+/CD56+ cells were cultured in RPMI complete medium i.e. RPMI1640 (Biochrom AG, #FG1215) supplemented with 10% FBS (Biochrom AG, #S0115), 1× non-essential amino acids (Biochrom AG, #K0293), 10 mM Hepes buffer (Biochrom AG, #L1613), 1 mM sodium pyruvate (Biochrom AG, #L0473) and 100 U/mL penicillin/streptomycin (Biochrom AG, #A2213) at 37° C. in an incubator until needed.

Target Cell Labeling

For the analysis of cell lysis in flow cytometry assays, the fluorescent membrane dye DiOC$_{18}$ (DiO) (Molecular Probes, #V22886) was used to label human BCMA- or macaque BCMA-transfected CHO cells as target cells and distinguish them from effector cells. Briefly, cells were harvested, washed once with PBS and adjusted to 10$^6$ cell/mL in PBS containing 2% (v/v) FBS and the membrane dye DiO (5 µL/10$^6$ cells). After incubation for 3 min at 37° C., cells were washed twice in complete RPMI medium and the cell number adjusted to 1.25×10$^5$ cells/mL. The vitality of cells was determined using 0.5% (v/v) isotonic EosinG solution (Roth, #45380).

Flow Cytometry Based Analysis

This assay was designed to quantify the lysis of macaque or human BCMA-transfected CHO cells in the presence of serial dilutions of BCMA bispecific antibodies.

Equal volumes of DiO-labeled target cells and effector cells (i.e., PBMC w/o CD14$^+$ cells) were mixed, resulting in an E:T cell ratio of 10:1. 160 µL of this suspension were transferred to each well of a 96-well plate. 40 µL of serial dilutions of the BCMA bispecific antibodies and a negative control bispecific (an CD3-based bispecific antibody recognizing an irrelevant target antigen) or RPMI complete medium as an additional negative control were added. The bispecific antibody-mediated cytotoxic reaction proceeded for 48 hours in a 7% CO$_2$ humidified incubator. Then cells were transferred to a new 96-well plate and loss of target cell membrane integrity was monitored by adding propidium iodide (PI) at a final concentration of 1 µg/mL. PI is a membrane impermeable dye that normally is excluded from viable cells, whereas dead cells take it up and become identifiable by fluorescent emission.

Samples were measured by flow cytometry on a FACSCanto II instrument and analyzed by FACSDiva software (both from Becton Dickinson).

Target cells were identified as DiO-positive cells. PI-negative target cells were classified as living target cells. Percent age of cytotoxicity was calculated according to the following formula:

$$\text{Cytotoxicity [\%]} = \frac{n_{dead\ target\ cells}}{n_{target\ cells}} \times 100$$

n = number of events

Using GraphPad Prism 5 software (Graph Pad Software, San Diego), the percentage of cytotoxicity was plotted against the corresponding bispecific antibody concentrations. Dose response curves were analyzed with the four parametric logistic regression models for evaluation of sigmoid dose response curves with fixed hill slope and EC50 values were calculated.

Example C10

Exclusion of Cross-Reactivity with BAFF-Receptor

For flow cytometry, 200,000 cells of the respective cell lines were incubated for 30 min on ice with 50 µl of purified bispecific molecules at a concentration of 5 µg/ml. The cells were washed twice in PBS with 2% FCS and binding of the constructs was detected with a murine PentaHis antibody (Qiagen; diluted 1:20 in 50 µl PBS with 2% FCS). After washing, bound PentaHis antibodies were detected with an Fc gamma-specific antibody (Dianova) conjugated to phycoerythrin, diluted 1:100 in PBS with 2% FCS. Samples were measured by flow cytometry on a FACSCanto II instrument and analyzed by FACSDiva software (both from Becton Dickinson). The bispecific binders were shown to not be cross-reactive with BAFF receptor.

Example C11

Cytotoxic Activity

The potency of human-like BCMA bispecific antibodies in redirecting effector T cells against BCMA-expressing target cells is analyzed in five additional in vitro cytotoxicity assays:

1. The potency of BCMA bispecific antibodies in redirecting stimulated human effector T cells against a BCMA-positive (human) tumor cell line is measured in a 51-chromium release assay.

2. The potency of BCMA bispecific antibodies in redirecting the T cells in unstimulated human PBMC against human BCMA-transfected CHO cells is measured in a FACS-based cytotoxicity assay.

3. The potency of BCMA bispecific antibodies in redirecting the T cells in unstimulated human PBMC against a BCMA-positive (human) tumor cell line is measured in a FACS-based cytotoxicity assay.

4. For confirmation that the cross-reactive BCMA bispecific antibodies are capable of redirecting macaque T cells against macaque BCMA-transfected CHO cells, a FACS-based cytotoxicity assay is performed with a macaque T cell line as effector T cells.

5. The potency gap between monomeric and dimeric forms of BCMA bispecific antibodies is determined in a 51-chromium release assay using human BCMA-transfected CHO cells as target cells and stimulated human T cells as effector cells.

Examples D

Example D1

Generation of CHO Cells Expressing Chimeric BCMA

For the construction of the chimeric epitope mapping molecules, the amino acid sequence of the respective epitope domains or the single amino acid residue of human BCMA was changed to the murine sequence. The following molecules were constructed:

Human BCMA ECD/E1 murine (SEQ ID NO: 1009)
Chimeric extracellular BCMA domain: Human extracellular BCMA domain wherein epitope cluster 1 (amino acid residues 1-7 of SEQ ID NO: 1002 or 1007) is replaced by the respective murine cluster (amino acid residues 1-4 of SEQ ID NO: 1004 or 1008)→deletion of amino acid residues 1-3 and G6Q mutation in SEQ ID NO: 1002 or 1007

Human BCMA ECD/E2 murine (SEQ ID NO: 1010)
Chimeric extracellular BCMA domain: Human extracellular BCMA domain wherein epitope cluster 2 (amino acid residues 8-21 of SEQ ID NO: 1002 or 1007) is replaced by the respective murine cluster (amino acid residues 5-18 of SEQ ID NO: 1004 or 1008)→S9F, Q10H, and N115 mutations in SEQ ID NO: 1002 or 1007

Human BCMA ECD/E3 murine (SEQ ID NO: 1011)
Chimeric extracellular BCMA domain: Human extracellular BCMA domain wherein epitope cluster 3 (amino acid residues 24-41 of SEQ ID NO: 1002 or 1007) is replaced by the respective murine cluster (amino acid residues 21-36 of SEQ ID NO: 1004 or 1008)→deletion of amino acid residues 31 and 32 and Q25H, S30N, L35A, and R39P mutation in SEQ ID NO: 1002 or 1007

Human BCMA ECD/E4 murine (SEQ ID NO: 1012)
Chimeric extracellular BCMA domain: Human extracellular BCMA domain wherein epitope cluster 4 (amino acid residues 42-54 of SEQ ID NO: 1002 or 1007) is replaced by the respective murine cluster (amino acid residues 37-49 of SEQ ID NO: 1004 or 1008)→N42D, A43P, N47S, N53Y and A54T mutations in SEQ ID NO: 1002 or 1007

Human BCMA ECD/E5 murine (SEQ ID NO: 1013)
Chimeric extracellular BCMA domain: Human extracellular BCMA domain wherein the amino acid residue at position 22 of SEQ ID NO: 1002 or 1007 (isoleucine) is replaced by its respective murine amino acid residue of SEQ ID NO: 1004 or 1008 (lysine, position 19)→I22K mutation in SEQ ID NO: 1002 or 1007

Human BCMA ECD/E6 murine (SEQ ID NO: 1014)
Chimeric extracellular BCMA domain: Human extracellular BCMA domain wherein the amino acid residue at position 25 of SEQ ID NO: 1002 or 1007 (glutamine) is replaced by its respective murine amino acid residue of SEQ ID NO: 1004 or 1008 (histidine, position 22)→Q25H mutation in SEQ ID NO: 1002 or 1007

Human BCMA ECD/E7 murine (SEQ ID NO: 1015)
Chimeric extracellular BCMA domain: Human extracellular BCMA domain wherein the amino acid residue at position 39 of SEQ ID NO: 1002 or 1007 (arginine) is replaced by its respective murine amino acid residue of SEQ ID NO: 1004 or 1008 (proline, position 34)→R39P mutation in SEQ ID NO: 1002 or 1007

The cDNA constructs were cloned into the mammalian expression vector pEF-DHFR and stably transfected into CHO cells. The expression of human BCMA on CHO cells was verified in a FACS assay using a monoclonal anti-human BCMA antibody. Murine BCMA expression was demonstrated with a monoclonal anti-mouse BCMA-antibody. The used concentration of the BCMA antibodies was 10 µg/ml in PBS/2% FCS. Bound monoclonal antibodies were detected with an anti-rat-IgG-Fcγ-PE (1:100 in PBS/2% FCS; Jackson-Immuno-Research #112-116-071). As negative control, cells were incubated with PBS/2% FCS instead of the first antibody. The samples were measured by flow cytometry on a FACSCanto II instrument (Becton Dickinson) and analyzed by FlowJo software (Version 7.6). The surface expression of human-murine BCMA chimeras, transfected CHO cells were analyzed and confirmed in a flow cytometry assay with different anti-BCMA antibodies (FIG. 2).

Example D2

2.1 Transient Expression in HEK 293 Cells

Clones of the expression plasmids with sequence-verified nucleotide sequences were used for transfection and protein expression in the FreeStyle 293 Expression System (Invitrogen GmbH, Karlsruhe, Germany) according to the manufacturer's protocol. Supernatants containing the expressed proteins were obtained, cells were removed by centrifugation and the supernatants were stored at −20 C.

2.2 Stable Expression in CHO Cells

Clones of the expression plasmids with sequence-verified nucleotide sequences were transfected into DHFR deficient CHO cells for eukaryotic expression of the constructs. Eukaryotic protein expression in DHFR deficient CHO cells was performed as described by Kaufman R. J. (1990) Methods Enzymol. 185, 537-566. Gene amplification of the constructs was induced by increasing concentrations of methotrexate (MTX) to a final concentration of 20 nM MTX. After two passages of stationary culture the cells were grown in roller bottles with nucleoside-free HyQ PF CHO liquid soy medium (with 4.0 mM L-Glutamine with 0.1% Pluronic F-68; HyClone) for 7 days before harvest. The cells were removed by centrifugation and the supernatant containing the expressed protein was stored at −20 C.

Example D3

Epitope Clustering of Murine scFv-Fragments

Cells transfected with human or murine BCMA, or with chimeric BCMA molecules were stained with crude, undiluted periplasmic extract containing scFv binding to human/macaque BCMA. Bound scFv were detected with 1 µg/ml of an anti-FLAG antibody (Sigma F1804) and a R-PE-labeled anti-mouse Fc gamma-specific antibody (1:100; Dianova #115-116-071). All antibodies were diluted in PBS with 2% FCS. As negative control, cells were incubated with PBS/2% FCS instead of the periplasmic extract. The samples were measured by flow cytometry on a FACSCanto II instrument (Becton Dickinson) and analyzed by FlowJo software (Version 7.6).

Example D4

Procurement of Different Recombinant Forms of Soluble Human and Macaque BCMA

The coding sequences of human and rhesus BCMA (as published in GenBank, accession numbers NM_001192 [human], XM_001106892 [rhesus]) coding sequences of human albumin, human Fcγ1 and murine albumin were used for the construction of artificial cDNA sequences encoding soluble fusion proteins of human and macaque BCMA respectively and human albumin, human IgG1 Fc and murine albumin respectively as well as soluble proteins comprising only the extracellular domains of BCMA. To generate the constructs for expression of the soluble human and macaque BCMA proteins, cDNA fragments were obtained by PCR mutagenesis of the full-length BCMA cDNAs described above and molecular cloning according to standard protocols.

For the fusions with human albumin, the modified cDNA fragments were designed as to contain first a Kozak site for eukaryotic expression of the constructs followed by the coding sequence of the human and rhesus BCMA proteins respectively, comprising amino acids 1 to 54 and 1 to 53 corresponding to the extracellular domain of human and rhesus BCMA, respectively, followed in frame by the coding sequence of an artificial Ser1-Gly4-Ser1-linker, followed in frame by the coding sequence of human serum albumin, followed in frame by the coding sequence of a Flag tag, followed in frame by the coding sequence of a modified histidine tag (SGHHGGHHGGHH; SEQ ID NO: 1094) and a stop codon.

For the fusions with murine IgG1, the modified cDNA fragments were designed as to contain first a Kozak site for eukaryotic expression of the constructs followed by the coding sequence of the human and macaque BCMA proteins respectively, comprising amino acids 1 to 54 and 1 to 53 corresponding to the extracellular domain of human and rhesus BCMA, respectively, followed in frame by the coding sequence of an artificial Ser1-Gly4-Ser1-linker, followed in frame by the coding sequence of the hinge and Fc gamma portion of human IgG1, followed in frame by the coding sequence of a hexahistidine tag and a stop codon.

For the fusions with murine albumin, the modified cDNA fragments were designed as to contain first a Kozak site for eukaryotic expression of the constructs followed by the coding sequence of the human and macaque BCMA proteins respectively, comprising amino acids 1 to 54 and 1 to 53 corresponding to the extracellular domain of human and rhesus BCMA, respectively, followed in frame by the coding sequence of an artificial Ser1-Gly4-Ser1-linker, followed in frame by the coding sequence of murine serum albumin, followed in frame by the coding sequence of a Flag tag, followed in frame by the coding sequence of a modified histidine tag (SGHHGGHHGGHH; SEQ ID NO: 1094) and a stop codon.

For the soluble extracellular domain constructs, the modified cDNA fragments were designed as to contain first a Kozak site for eukaryotic expression of the constructs followed by the coding sequence of the human and macaque BCMA proteins respectively, comprising amino acids 1 to 54 and 1 to 53 corresponding to the extracellular domain of human and rhesus BCMA, respectively, followed in frame by the coding sequence of an artificial Ser1-Gly1-linker, followed in frame by the coding sequence of a Flag tag, followed in frame by the coding sequence of a modified histidine tag (SGHHGGHHGGHHH; SEQ ID NO: 1094) and a stop codon.

The cDNA fragments were also designed to introduce restriction sites at the beginning and at the end of the fragments. The introduced restriction sites, EcoRI at the 5' end and SalI at the 3' end, were utilized in the following cloning procedures. The cDNA fragments were cloned via EcoRI and SalI into a plasmid designated pEF-DHFR (pEF-DHFR is described in Raum et al. Cancer Immunol Immunother 50 (2001) 141-150). The aforementioned procedures were all carried out according to standard protocols (Sambrook, Molecular Cloning; A Laboratory Manual, 3rd edition, Cold Spring Harbour Laboratory Press, Cold Spring Harbour, N.Y. (2001)).

Example D5

Biacore-Based Determination of Bispecific Antibody Affinity to Human and Macaque BCMA and CD3

Biacore analysis experiments were performed using recombinant BCMA fusion proteins with human serum albumin (ALB) to determine BCMA target binding. For CD3 affinity measurements, recombinant fusion proteins having the N-terminal 27 amino acids of the CD3 epsilon (CD3e) fused to human antibody Fc portion were used. This recombinant protein exists in a human CD3e1-27 version and in a cynomolgous CD3e version, both bearing the epitope of the CD3 binder in the bispecific antibodies.

In detail, CM5 Sensor Chips (GE Healthcare) were immobilized with approximately 100 to 150 RU of the respective recombinant antigen using acetate buffer pH4.5 according to the manufacturer's manual. The bispecific antibody samples were loaded in five concentrations: 50 nM, 25 nM, 12.5 nM, 6.25 nM and 3.13 nM diluted in HBS-EP running buffer (GE Healthcare). Flow rate was 30 to 35 µl/min for 3 min, then HBS-EP running buffer was applied for 8 min again at a flow rate of 30 to 35 µl/ml. Regeneration of the chip was performed using 10 mM glycine 0.5 M NaCl pH 2.45. Data sets were analyzed using BiaEval Software (see FIG. D4). In general two independent experiments were performed.

Example D6

Bispecific Binding and Interspecies Cross-Reactivity

For flow cytometry, 200,000 cells of the respective cell lines were incubated for 30 min on ice with 50 µl of purified bispecific molecules at a concentration of 5 µg/ml. The cells were washed twice in PBS with 2% FCS and binding of the constructs was detected with a murine PentaHis antibody (Qiagen; diluted 1:20 in 50 µl PBS with 2% FCS). After washing, bound PentaHis antibodies were detected with an Fc gamma-specific antibody (Dianova) conjugated to phycoerythrin, diluted 1:100 in PBS with 2% FCS.

Example D7

Scatchard-Based Determination of Bispecific-Antibody Affinity to Human and Macaque BCMA For Scatchard analysis, saturation binding experiments are performed using a monovalent detection system developed at Micromet (anti-His Fab/Alexa 488) to precisely determine monovalent binding of the bispecific antibodies to the respective cell line.

$2 \times 10^4$ cells of the respective cell line (recombinantly human BCMA-expressing CHO cell line, recombinantly macaque BCMA-expressing CHO cell line) are incubated with each 50 µl of a triplet dilution series (eight dilutions at 1:2) of the respective BCMA bispecific antibody starting at 100 nM followed by 16 h incubation at 4° C. under agitation and one residual washing step. Then, the cells are incubated for further 30 min with 30 µl of an anti-His Fab/Alexa488 solution (Micromet; 30 µg/ml). After one washing step, the cells are resuspended in 150 µl FACS buffer containing 3.5% formaldehyde, incubated for further 15 min, centrifuged, resuspended in FACS buffer and analyzed using a FACS Cantoll machine and FACS Diva software. Data are generated from two independent sets of experiments. Values are plotted as hyperbole binding curves. Respective Scatchard analysis is calculated to extrapolate maximal binding (Bmax). The concentrations of bispecific antibodies at half-maximal binding are determined reflecting the respective KDs. Values of triplicate measurements are plotted as hyperbolic curves. Maximal binding is determined using Scatchard evaluation and the respective KDs are calculated.

Example D8

Cytotoxic Activity 8.1 Chromium Release Assay with Stimulated Human T Cells
Stimulated T cells enriched for CD8$^+$ T cells were obtained as described below.

A petri dish (145 mm diameter, Greiner bio-one GmbH, Kremsmünster) was coated with a commercially available anti-CD3 specific antibody (OKT3, Orthoclone) in a final concentration of 1 µg/ml for 1 hour at 37° C. Unbound protein was removed by one washing step with PBS. $3\text{-}5 \times 10^7$ human PBMC were added to the precoated petri dish in 120 ml of RPMI 1640 with stabilized glutamine/10% FCS/IL-2 20 U/ml (Proleukin®, Chiron) and stimulated for 2 days. On the third day, the cells were collected and washed once with RPMI 1640. IL-2 was added to a final concentration of 20 U/ml and the cells were cultured again for one day in the same cell culture medium as above.

CD8$^+$ cytotoxic T lymphocytes (CTLs) were enriched by depletion of CD4$^+$ T cells and CD56$^+$ NK cells using Dynal-Beads according to the manufacturer's protocol.

Macaque or human BCMA-transfected CHO target cells were washed twice with PBS and labeled with 11.1 MBq $^{51}$Cr in a final volume of 100 µl RPMI with 50% FCS for 60 minutes at 37° C. Subsequently, the labeled target cells were washed 3 times with 5 ml RPMI and then used in the cytotoxicity assay. The assay was performed in a 96-well plate in a total volume of 200 µl supplemented RPMI with an E:T ratio of 10:1. A starting concentration of 0.01-1 µg/ml of purified bispecific antibody and threefold dilutions thereof were used. Incubation time for the assay was 18 hours. Cytotoxicity was determined as relative values of released chromium in the supernatant relative to the difference of maximum lysis (addition of Triton-X) and spontaneous lysis (without effector cells). All measurements were carried out in quadruplicates. Measurement of chromium activity in the supernatants was performed in a Wizard 3" gammacounter (Perkin Elmer Life Sciences GmbH, Köln, Germany). Analysis of the results was carried out with Prism 5 for Windows (version 5.0, GraphPad Software Inc., San Diego, Calif., USA). EC50 values calculated by the analysis program from the sigmoidal dose response curves were used for comparison of cytotoxic activity (see FIG. D5).

8.2 FACS-Based Cytotoxicity Assay with Unstimulated Human PBMC
Isolation of Effector Cells Human peripheral blood mononuclear cells (PBMC) were prepared by Ficoll density gradient centrifugation from enriched lymphocyte preparations (buffy coats), a side product of blood banks collecting blood for transfusions. Buffy coats were supplied by a local blood bank and PBMC were prepared on the same day of blood collection. After Ficoll density centrifugation and extensive washes with Dulbecco's PBS (Gibco), remaining erythrocytes were removed from PBMC via incubation with erythrocyte lysis buffer (155 mM $NH_4Cl$, 10 mM $KHCO_3$, 100 µM EDTA). Platelets were removed via the supernatant upon centrifugation of PBMC at 100×g. Remaining lymphocytes mainly encompass B and T lymphocytes, NK cells and monocytes. PBMC were kept in culture at 37° C./5% $CO_2$ in RPMI medium (Gibco) with 10% FCS (Gibco).

Depletion of $CD14^+$ and $CD56^+$ Cells

For depletion of $CD14^+$ cells, human CD14 MicroBeads (Milteny Biotec, MACS, #130-050-201) were used, for depletion of NK cells human CD56 MicroBeads (MACS, #130-050-401). PBMC were counted and centrifuged for 10 min at room temperature with 300×g. The supernatant was discarded and the cell pellet resuspended in MACS isolation buffer [80 µL/$10^7$ cells; PBS (Invitrogen, #20012-043), 0.5% (v/v) FBS (Gibco, #10270-106), 2 mM EDTA (Sigma-Aldrich, #E-6511)]. CD14 MicroBeads and CD56 MicroBeads (20 µL/$10^7$ cells) were added and incubated for 15 min at 4-8° C. The cells were washed with MACS isolation buffer (1-2 mL/$10^7$ cells). After centrifugation (see above), supernatant was discarded and cells resuspended in MACS isolation buffer (500 µL/$10^8$ cells). CD14/CD56 negative cells were then isolated using LS Columns (Miltenyi Biotec, #130-042-401). PBMC w/o CD14+/CD56+ cells were cultured in RPMI complete medium i.e. RPMI1640 (Biochrom AG, #FG1215) supplemented with 10% FBS (Biochrom AG, #S0115), 1× non-essential amino acids (Biochrom AG, #K0293), 10 mM Hepes buffer (Biochrom AG, #L1613), 1 mM sodium pyruvate (Biochrom AG, #L0473) and 100 U/mL penicillin/streptomycin (Biochrom AG, #A2213) at 37° C. in an incubator until needed.

Target Cell Labeling

For the analysis of cell lysis in flow cytometry assays, the fluorescent membrane dye $DiOC_{18}$ (DiO) (Molecular Probes, #V22886) was used to label human BCMA- or macaque BCMA-transfected CHO cells as target cells and distinguish them from effector cells. Briefly, cells were harvested, washed once with PBS and adjusted to $10^6$ cell/mL in PBS containing 2% (v/v) FBS and the membrane dye DiO (5 µL/$10^6$ cells). After incubation for 3 min at 37° C., cells were washed twice in complete RPMI medium and the cell number adjusted to 1.25×$10^5$ cells/mL. The vitality of cells was determined using 0.5% (v/v) isotonic EosinG solution (Roth, #45380).

Flow Cytometry Based Analysis

This assay was designed to quantify the lysis of macaque or human BCMA-transfected CHO cells in the presence of serial dilutions of BCMA bispecific antibodies.

Equal volumes of DiO-labeled target cells and effector cells (i.e., PBMC w/o $CD14^+$ cells) were mixed, resulting in an E:T cell ratio of 10:1. 160 µL of this suspension were transferred to each well of a 96-well plate. 40 µL of serial dilutions of the BCMA bispecific antibodies and a negative control bispecific (an CD3-based bispecific antibody recognizing an irrelevant target antigen) or RPMI complete medium as an additional negative control were added. The bispecific antibody-mediated cytotoxic reaction proceeded for 48 hours in a 7% $CO_2$ humidified incubator. Then cells were transferred to a new 96-well plate and loss of target cell membrane integrity was monitored by adding propidium iodide (PI) at a final concentration of 1 µg/mL. PI is a membrane impermeable dye that normally is excluded from viable cells, whereas dead cells take it up and become identifiable by fluorescent emission.

Samples were measured by flow cytometry on a FACSCanto II instrument and analyzed by FACSDiva software (both from Becton Dickinson).

Target cells were identified as DiO-positive cells. PI-negative target cells were classified as living target cells. Percentage of cytotoxicity was calculated according to the following formula:

$$\text{Cytotoxicity } [\%] = \frac{n_{dead\ target\ cells}}{n_{target\ cells}} \times 100$$

$n$ = number of events

Using GraphPad Prism 5 software (Graph Pad Software, San Diego), the percentage of cytotoxicity was plotted against the corresponding bispecific antibody concentrations. Dose response curves were analyzed with the four parametric logistic regression models for evaluation of sigmoid dose response curves with fixed hill slope and EC50 values were calculated.

Example D9

Exclusion of Cross-Reactivity with BAFF-Receptor

For flow cytometry, 200,000 cells of the respective cell lines were incubated for 30 min on ice with 50 µl of purified bispecific molecules at a concentration of 5 µg/ml. The cells were washed twice in PBS with 2% FCS and binding of the constructs was detected with a murine PentaHis antibody (Qiagen; diluted 1:20 in 50 µl PBS with 2% FCS). After washing, bound PentaHis antibodies were detected with an Fc gamma-specific antibody (Dianova) conjugated to phycoerythrin, diluted 1:100 in PBS with 2% FCS. Samples were measured by flow cytometry on a FACSCanto II instrument and analyzed by FACSDiva software (both from Becton Dickinson). The bispecific binders were shown to not be cross-reactive with BAFF receptor.

Example D10

Cytotoxic Activity

The potency of human-like BCMA bispecific antibodies in redirecting effector T cells against BCMA-expressing target cells is analyzed in five additional in vitro cytotoxicity assays:
1. The potency of BCMA bispecific antibodies in redirecting stimulated human effector T cells against a BCMA-positive (human) tumor cell line is measured in a 51-chromium release assay.
2. The potency of BCMA bispecific antibodies in redirecting the T cells in unstimulated human PBMC against human BCMA-transfected CHO cells is measured in a FACS-based cytotoxicity assay.
3. The potency of BCMA bispecific antibodies in redirecting the T cells in unstimulated human PBMC against a BCMA-positive (human) tumor cell line is measured in a FACS-based cytotoxicity assay.
4. For confirmation that the cross-reactive BCMA bispecific antibodies are capable of redirecting macaque T cells against macaque BCMA-transfected CHO cells, a FACS-based cytotoxicity assay is performed with a macaque T cell line as effector T cells.
5. The potency gap between monomeric and dimeric forms of BCMA bispecific antibodies is determined in a 51-chromium release assay using human BCMA-transfected CHO cells as target cells and stimulated human T cells as effector cells.

SEQUENCE LISTING (1094 sequences)

SEQ ID NO: 1 - protein, 5 aa, artificial
  VH CDR1 of BCMA-1
NYDMA

SEQ ID NO: 2 - protein, 17 aa, artificial
  VH CDR2 of BCMA-1
SIITSGDATYYRDSVKG

SEQ ID NO: 3 - protein, 12 aa, artificial
  VH CDR3 of BCMA-1
HDYYDGSYGFAY

SEQ ID NO: 4 - protein, 11 aa, artificial
  VL CDR1 of BCMA-1
KASQSVGINVD

SEQ ID NO: 5 - protein, 7 aa, artificial
  VL CDR2 of BCMA-1
GASNRHT

SEQ ID NO: 6 - protein, 9 aa, artificial
  VL CDR3 of BCMA-1
LQYGSIPFT

SEQ ID NO: 7 - protein, 121 aa, artificial
  VH of BCMA-1
QVQLVESGGGVVQPGRSLRLSCAASGFTFSNYDMAWVRQAPGKGLEWVASIITSGDATYYRDSVKGRFTISRDNSKNTLYLQMNSLRAEDTAVYYCVRHDYYDGSYGFAYWGQGTLVTVSS

SEQ ID NO: 8 - protein, 107 aa, artificial
  VL of BCMA-1
EIVMTQSPATLSVSPGERVTLSCKASQSVGINVDWYQQKPGQAPRLLIYGASNRHTGIPARFSGSGSGREFTLTISSLQSEDFAVYYCLQYGSIPFTFGPGTKVDIK

SEQ ID NO: 9 - protein, 243 aa, artificial
  BCMA-1 scFv
QVQLVESGGGVVQPGRSLRLSCAASGFTFSNYDMAWVRQAPGKGLEWVASIITSGDATYYRDSVKGRFTISRDNSKNTLYLQMNSLRAEDTAVYYCVRHDYYDGSYGFAYWGQGTLVTVSSGGGGSGGGGSGGGGSEIVMTQSPATLSVSPGERVTLSCKASQSVGINVDWYQQKPGQAPRLLIYGASNRHTGIPARFSGSGSGREFTLTISSLQSEDFAVYYCLQYGSIPFTFGPGTKVDIK

SEQ ID NO: 10 - protein, 498 aa, artificial
  BCMA-1 HL x CD3 HL bispecific molecule
QVQLVESGGGVVQPGRSLRLSCAASGFTFSNYDMAWVRQAPGKGLEWVASIITSGDATYYRDSVKGRFTISRDNSKNTLYLQMNSLRAEDTAVYYCVRHDYYDGSYGFAYWGQGTLVTVSSGGGGSGGGGSGGGGSEIVMTQSPATLSVSPGERVTLSCKASQSVGINVDWYQQKPGQAPRLLIYGASNRHTGIPARFSGSGSGREFTLTISSLQSEDFAVYYCLQYGSIPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 11 - protein, 5 aa, artificial
  VH CDR1 of BCMA-2
NYDMA

SEQ ID NO: 12 - protein, 17 aa, artificial
  VH CDR2 of BCMA-2
SIITSGDMTYYRDSVKG

SEQ ID NO: 13 - protein, 12 aa, artificial
  VH CDR3 of BCMA-2
HDYYDGSYGFAY

SEQ ID NO: 14 - protein, 11 aa, artificial
  VL CDR1 of BCMA-2
KASQSVGINVD

SEQ ID NO: 15 - protein, 7 aa, artificial
  VL CDR2 of BCMA-2
GASNRHT

SEQ ID NO: 16 - protein, 9 aa, artificial
  VL CDR3 of BCMA-2
LQYGSIPFT

SEQ ID NO: 17 - protein, 121 aa, artificial
  VH of BCMA-2
QVQLVESGGGVVQPGRSLRLSCAASGFTFSNYDMAWVRQAPGKGLEWVASIITSGDMTYYRDSVKGRFTISRDNSKNTLYLQMNSLRAEDTAVYYCVRHDYYDGSYGFAYWGQGTLVTVSS

SEQ ID NO: 18 - protein, 107 aa, artificial; identical to SEQ ID NO: 8
  VL of BCMA-2

SEQ ID NO: 19 - protein, 243 aa, artificial
  BCMA-2 scFv
QVQLVESGGGVVQPGRSLRLSCAASGFTFSNYDMAWVRQAPGKGLEWVASIITSGDMTYYRDSVKGRFTISRDNSKNTLYLQMNSLRAEDTAVYYCVRHDYYDGSYGFAYWGQGTLVTVSSGGGGSGGGGSGGGGSEIVMTQSPATLSVSPGERVTLSCKASQSVGINVDWYQQKPGQAPRLLIYGASNRHTGIPARFSGSGSGREFTLTISSLQSEDFAVYYCLQYGSIPFTFGPGTKVDIK

SEQ ID NO: 20 - protein, 498 aa, artificial
  BCMA-2 HL x CD3 HL bispecific molecule
QVQLVESGGGVVQPGRSLRLSCAASGFTFSNYDMAWVRQAPGKGLEWVASIITSGDMTYYRDSVKGRFTISRDNSKNTLYLQMNSLRAEDTAVYYCVRHDYYDGSYGFAYWGQGTLVTVSSGGGGSGGGGSGGGGSEIVMTQSPATLSVSPGERVTLSCKASQSVGINVDWYQQKPGQAPRLLIYGASNRHTGIPARFSGSGSGREFTLTISSLQSEDFAVYYCLQYGSIPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 21 - protein, 5 aa, artificial
  VH CDR1 of BCMA-3
NYDMA

SEQ ID NO: 22 - protein, 17 aa, artificial
  VH CDR2 of BCMA-3
SIITSGDATYYRDSVKG

SEQ ID NO: 23 - protein, 12 aa, artificial
  VH CDR3 of BCMA-3
HDYYDGSYGFAY

SEQ ID NO: 24 - protein, 11 aa, artificial
  VL CDR1 of BCMA-3
KASQSVGINVD

SEQ ID NO: 25 - protein, 7 aa, artificial
  VL CDR2 of BCMA-3
GASNRHT

SEQ ID NO: 26 - protein, 9 aa, artificial
  VL CDR3 of BCMA-3
LQYGSIPFT

SEQ ID NO: 27 - protein, 121 aa, artificial
  VH of BCMA-3
QVQLVESGGGVVQPGRSLRLSCAASGFTFSNYDMAWVRQAPGKGLEWVASIITSGDATYYRDSVKGRFTISRDNSKNTLYLQMNSLRSEDTAVYYCVRHDYYDGSYGFAYWGQGTLVTVSS

SEQ ID NO: 28 - protein, 107 aa, artificial
  VL of BCMA-3
EIVMTQSPATLSVSPGERVTLSCKASQSVGINVDWYQQKPGQAPRLLIYGASNRHTGIPARFSGSGSGTEFTLTISSLQSEDFAVYYCLQYGSIPFTFGPGTKVDIK

SEQ ID NO: 29 - protein, 243 aa, artificial
  BCMA-3 scFv
QVQLVESGGGVVQPGRSLRLSCAASGFTFSNYDMAWVRQAPGKGLEWVASIITSGDATYYRDSVKGRFTISRDNSKNTLYLQMNSLRSEDTAVYYCVRHDYYDGSYGFAYWGQGTLVTVSSGGGGSGGGGSGGGGSEIVMTQSPATLSVSPGERVTLSCKASQSVGINVDWYQQKPGQAPRLLIYGASNRHTGIPARFSGSGSGTEFTLTISSLQSEDFAVYYCLQYGSIPFTFGPGTKVDIK

SEQ ID NO: 30 - protein, 498 aa, artificial
  BCMA-3 HL x CD3 HL bispecific molecule
QVQLVESGGGVVQPGRSLRLSCAASGFTFSNYDMAWVRQAPGKGLEWVASIITSGDATYYRDSVKGRFTISRDNSKNTLYLQMNSLRSEDTAVYYCVRHDYYDGSYGFAYWGQGTLVTVSSGGGGSGGGGSGGGGSEIVMTQSPATLSVSPGERVTLSCKASQSVGINVDWYQQKPGQAPRLLIYGASNRHTGIPARFSGSGSGTEFTLTISSLQSEDFAVYYCLQYGSIPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 31 - protein, 5 aa, artificial
  VH CDR1 of BCMA-4
NYDMA

SEQ ID NO: 32 - protein, 17 aa, artificial
  VH CDR2 of BCMA-4
SIITSGDMTYYRDSVKG

SEQ ID NO: 33 - protein, 12 aa, artificial
  VH CDR3 of BCMA-4
HDYYDGSYGFAY

SEQ ID NO: 34 - protein, 11 aa, artificial
  VL CDR1 of BCMA-4
KASQSVGINVD

SEQ ID NO: 35 - protein, 7 aa, artificial
  VL CDR2 of BCMA-4
GASNRHT

SEQ ID NO: 36 - protein, 9 aa, artificial
  VL CDR3 of BCMA-4
LQYGSIPFT

SEQ ID NO: 37 - protein, 121 aa, artificial
  VH of BCMA-4
QVQLVESGGGVVQPGRSLRLSCAASGFTFSNYDMAWVRQAPGKGLEWVASIITSGDMTYYRDSVKGRFTISRDNSKNTLYLQMNSLRSEDTAVYYCVRHDYYDGSYGFAYWGQGTLVTVSS

SEQ ID NO: 38 - protein, 107 aa, artificial; identical to SEQ ID NO: 28
  VL of BCMA-4

SEQ ID NO: 39 - protein, 243 aa, artificial
  BCMA-4 scFv
QVQLVESGGGVVQPGRSLRLSCAASGFTFSNYDMAWVRQAPGKGLEWVASIITSGDMTYYRDSVKGRFTISRDNSKNTLYLQMNSLRSEDTAVYYCVRHDYYDGSYGFAYWGQGTLVTVSSGGGGSGGGGSGGGGSEIVMTQSPATLSVSPGERVTLSCKASQSVGINVDWYQQKPGQAPRLLIYGASNRHTGIPARFSGSGSGTEFTLTISSLQSEDFAVYYCLQYGSIPFTFGPGTKVDIK

SEQ ID NO: 40 - protein, 498 aa, artificial
  BCMA-4 HL x CD3 HL bispecific molecule
QVQLVESGGGVVQPGRSLRLSCAASGFTFSNYDMAWVRQAPGKGLEWVASIITSGDMTYYRDSVKGRFTISRDNSKNTLYLQMNSLRSEDTAVYYCVRHDYYDGSYGFAYWGQGTLVTVSSGGGGSGGGGSGGGGSEIVMTQSPATLSVSPGERVTLSCKASQSVGINVDWYQQKPGQAPRLLIYGASNRHTGIPARFSGSGSGTEFTLTISSLQSEDFAVYYCLQYGSIPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 41 - protein, 5 aa, artificial
  VH CDR1 of BCMA-5
NYDMA

SEQ ID NO: 42 - protein, 17 aa, artificial
  VH CDR2 of BCMA-5
SIITSGDATYYRDSVKG

SEQ ID NO: 43 - protein, 12 aa, artificial
  VH CDR3 of BCMA-5
HDYYDGSYGFAY

SEQ ID NO: 44 - protein, 11 aa, artificial
  VL CDR1 of BCMA-5
KASQSVGINVD

SEQ ID NO: 45 - protein, 7 aa, artificial
  VL CDR2 of BCMA-5
GASNRHT

SEQ ID NO: 46 - protein, 9 aa, artificial
  VL CDR3 of BCMA-5
LQYGSIPFT

SEQ ID NO: 47 - protein, 121 aa, artificial
  VH of BCMA-5
QVQLVESGGGVVQPGRSLRLSCAASGFTFSNYDMAWVRQAPGKGLEWVASIITSGDATYYRDSVKGRFTISRDNAKNTLYLQMNSLRAEDTAVYYCVRHDYYDGSYGFAYWGQGTLVTVSS

SEQ ID NO: 48 - protein, 107 aa, artificial
  VL of BCMA-5
EIVMTQSPASMSVSPGERATLSCKASQSVGINVDWYQQKPGQAPRLLIYGASNRHTGIPARFSGSGSGTEFTLTISSLQSEDFAVYYCLQYGSIPFTFGPGTKVDIK

SEQ ID NO: 49 - protein, 243 aa, artificial
  BCMA-5 scFv
QVQLVESGGGVVQPGRSLRLSCAASGFTFSNYDMAWVRQAPGKGLEWVASIITSGDATYYRDSVKGRFTISRDNAKNTLYLQMNSLRAEDTAVYYCVRHDYYDGSYGFAYWGQGTLVTVSSGGGGSGGGGSGGGGSEIVMTQSPASMSVSPGERATLSCKASQSVGINVDWYQQKPGQAPRLLIYGASNRHTGIPARFSGSGSGTEFTLTISSLQSEDFAVYYCLQYGSIPFTFGPGTKVDIK

SEQ ID NO: 50 - protein, 498 aa, artificial
  BCMA-5 HL x CD3 HL bispecific molecule
QVQLVESGGGVVQPGRSLRLSCAASGFTFSNYDMAWVRQAPGKGLEWVASIITSGDATYYRDSVKGRFTISRDNAKNTLYLQMNSLRAEDTAVYYCVRHDYYDGSYGFAYWGQGTLVTVSSGGGGSGGGGSGGGGSEIVMTQSPASMSVSPGERATLSCKASQSVGINVDWYQQKPGQAPRLLIYGASNRHTGIPARFSGSGSGTEFTLTISSLQSEDFAVYYCLQYGSIPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 51 - protein, 5 aa, artificial
  VH CDR1 of BCMA-6
NYDMA

SEQ ID NO: 52 - protein, 17 aa, artificial
  VH CDR2 of BCMA-6
SIITSGDMTYYRDSVKG

SEQ ID NO: 53 - protein, 12 aa, artificial
  VH CDR3 of BCMA-6
HDYYDGSYGFAY

SEQ ID NO: 54 - protein, 11 aa, artificial
  VL CDR1 of BCMA-6
KASQSVGINVD

SEQ ID NO: 55 - protein, 7 aa, artificial
  VL CDR2 of BCMA-6
GASNRHT

SEQ ID NO: 56 - protein, 9 aa, artificial
  VL CDR3 of BCMA-6
LQYGSIPFT

SEQ ID NO: 57 - protein, 121 aa, artificial
  VH of BCMA-6
QVQLVESGGGVVQPGRSLRLSCAASGFTFSNYDMAWVRQAPGKGLEWVASIITSGDMTYYRDSVKGRFTISRDNAKNTLYLQMNSLRAEDTAVYYCVRHDYYDGSYGFAYWGQGTLVTVSS

SEQ ID NO: 58 - protein, 107 aa, artificial; identical to SEQ ID NO: 48
  VL of BCMA-6

SEQ ID NO: 59 - protein, 243 aa, artificial
  BCMA-6 scFv
QVQLVESGGGVVQPGRSLRLSCAASGFTFSNYDMAWVRQAPGKGLEWVASIITSGDMTYYRDSVKGRFTISRDNAKNTLYLQMNSLRAEDTAVYYCVRHDYYDGSYGFAYWGQGTLVTVSSGGGGSGGGGSGGGGSEIVMTQSPASMSVSPGERATLSCKASQSVGINVDWYQQKPGQAPRLLIYGASNRHTGIPARFSGSGSGTEFTLTISSLQSEDFAVYYCLQYGSIPFTFGPGTKVDIK

SEQ ID NO: 60 - protein, 498 aa, artificial
  BCMA-6 HL x CD3 HL bispecific molecule
QVQLVESGGGVVQPGRSLRLSCAASGFTFSNYDMAWVRQAPGKGLEWVASIITSGDMTYYRDSVKGRFTISRDNAKNTLYLQMNSLRAEDTAVYYCVRHDYYDGSYGFAYWGQGTLVTVSSGGGGSGGGGSGGGGSEIVMTQSPASMSVSPGERATLSCKASQSVGINVDWYQQKPGQAPRLLIYGASNRHTGIPARFSGSGSGTEFTLTISSLQSEDFAVYYCLQYGSIPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 61 - protein, 5 aa, artificial
  VH CDR1 of BCMA-7
NYDMA

SEQ ID NO: 62 - protein, 17 aa, artificial
  VH CDR2 of BCMA-7
SIITSGDATYYRDSVKG

SEQ ID NO: 63 - protein, 12 aa, artificial
  VH CDR3 of BCMA-7
HDYYDGSYGFAY

SEQ ID NO: 64 - protein, 11 aa, artificial
  VL CDR1 of BCMA-7
KASQSVGINVD

SEQ ID NO: 65 - protein, 7 aa, artificial
  VL CDR2 of BCMA-7
GASNRHT

SEQ ID NO: 66 - protein, 9 aa, artificial
  VL CDR3 of BCMA-7
LQYGSIPFT

SEQ ID NO: 67 - protein, 121 aa, artificial
  VH of BCMA-7
QVQLVESGGGVVQPGRSLRLSCAASGFTFSNYDMAWVRQAPGKGLEWVASIITSGDATYYRDSVKGRFTVSRDNSKNTLYLQMNSLRAEDTAVYYCVRHDYYDGSYGFAYWGQGTLVTVSS

SEQ ID NO: 68 - protein, 107 aa, artificial
  VL of BCMA-7
EIVMTQSPATLSVSPGERATLSCKASQSVGINVDWYQQKPGQAPRLLIYGASNRHTGIPARFSGSGSGTEFTLTISSLQAEDFAVYYCLQYGSIPFTFGPGTKVDIK

SEQ ID NO: 69 - protein, 243 aa, artificial
  BCMA-7 scFv
QVQLVESGGGVVQPGRSLRLSCAASGFTFSNYDMAWVRQAPGKGLEWVASIITSGDATYYRDSVKGRFTVSRDNSKNTLYLQMNSLRAEDTAVYYCVRHDYYDGSYGFAYWGQGTLVTVSSGGGGSGGGGSGGGGSEIVMTQSPATLSVSPGERATLSCKASQSVGINVDWYQQKPGQAPRLLIYGASNRHTGIPARFSGSGSGTEFTLTISSLQAEDFAVYYCLQYGSIPFTFGPGTKVDIK

SEQ ID NO: 70 - protein, 498 aa, artificial
  BCMA-7 HL x CD3 HL bispecific molecule
QVQLVESGGGVVQPGRSLRLSCAASGFTFSNYDMAWVRQAPGKGLEWVASIITSGDATYYRDSVKGRFTVSRDNSKNTLYLQMNSLRAEDTAVYYCVRHDYYDGSYGFAYWGQGTLVTVSSGGGGSGGGGSGGGGSEIVMTQSPATLSVSPGERATLSCKASQSVGINVDWYQQKPGQAPRLLIYGASNRHTGIPARFSGSGSGTEFTLTISSLQAEDFAVYYCLQYGSIPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 71 - protein, 5 aa, artificial
  VH CDR1 of BCMA-8
NYDMA

SEQ ID NO: 72 - protein, 17 aa, artificial
  VH CDR2 of BCMA-8
SIITSGDMTYYRDSVKG

SEQ ID NO: 73 - protein, 12 aa, artificial
  VH CDR3 of BCMA-8
HDYYDGSYGFAY

SEQ ID NO: 74 - protein, 11 aa, artificial
  VL CDR1 of BCMA-8
KASQSVGINVD

SEQ ID NO: 75 - protein, 7 aa, artificial
  VL CDR2 of BCMA-8
GASNRHT

SEQ ID NO: 76 - protein, 9 aa, artificial
  VL CDR3 of BCMA-8
LQYGSIPFT

SEQ ID NO: 77 - protein, 121 aa, artificial
  VH of BCMA-8
QVQLVESGGGVVQPGRSLRLSCAASGFTFSNYDMAWVRQAPGKGLEWVASIITSGDMTYYRDSVKGRFTVSRDNSKNTLYLQMNSLRAEDTAVYYCVRHDYYDGSYGFAYWGQGTLVTVSS

SEQ ID NO: 78 - protein, 107 aa, artificial; identical to SEQ ID NO: 68
  VL of BCMA-8

SEQ ID NO: 79 - protein, 243 aa, artificial
  BCMA-8 scFv
QVQLVESGGGVVQPGRSLRLSCAASGFTFSNYDMAWVRQAPGKGLEWVASIITSGDMTYYRDSVKGRFTVSRDNSKNTLYLQMNSLRAEDTAVYYCVRHDYYDGSYGFAYWGQGTLVTVSSGGGGSGGGGSGGGGSEIVMTQSPATLSVSPGERATLSCKASQSVGINVDWYQQKPGQAPRLLIYGASNRHTGIPARFSGSGSGTEFTLTISSLQAEDFAVYYCLQYGSIPFTFGPGTKVDIK

SEQ ID NO: 80 - protein, 498 aa, artificial
  BCMA-8 HL x CD3 HL bispecific molecule
QVQLVESGGGVVQPGRSLRLSCAASGFTFSNYDMAWVRQAPGKGLEWVASIITSGDMTYYRDSVKGRFTVSRDNSKNTLYLQMNSLRAEDTAVYYCVRHDYYDGSYGFAYWGQGTLVTVSSGGGGSGGGGSGGGGSEIVMTQSPATLSVSPGERATLSCKASQSVGINVDWYQQKPGQAPRLLIYGASNRHTGIPARFSGSGSGTEFTLTISSLQAEDFAVYYCLQYGSIPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 81 - protein, 5 aa, artificial
  VH CDR1 of BCMA-9
NYWIH

SEQ ID NO: 82 - protein, 17 aa, artificial
  VH CDR2 of BCMA-9
AIYPGNSDTHYNQKFQG

SEQ ID NO: 83 - protein, 12 aa, artificial
  VH CDR3 of BCMA-9
SSYYYDGSLFAS

SEQ ID NO: 84 - protein, 16 aa, artificial
  VL CDR1 of BCMA-9
RSSQSIVHSNGNTYLY

SEQ ID NO: 85 - protein, 7 aa, artificial
  VL CDR2 of BCMA-9
RVSNRFS

SEQ ID NO: 86 - protein, 9 aa, artificial
  VL CDR3 of BCMA-9
FQGSTLPFT

SEQ ID NO: 87 - protein, 121 aa, artificial
  VH of BCMA-9
QVQLVQSGAEVKKPGASVKVSCKASGYTFTNYWIHWVKQAPGQRLEWIGAIYPGNSDTHYNQKFQGKVTITRDTSASTAYMELSSLTSEDTAVYYCTRSSYYYDGSLFASWGQGTLVTVSS

SEQ ID NO: 88 - protein, 112 aa, artificial
  VL of BCMA-9
DIVMTQTPLSLSVSPGQPASISCRSSQSIVHSNGNTYLYWYLQKPGQPPQLLIYRVSNRFSGVPDRFSGSGSGTDFTLKISRVEAEDVGVYYCFQGSTLPFTFGQGTKLEIK

SEQ ID NO: 89 - protein, 248 aa, artificial
  BCMA-9 scFv
QVQLVQSGAEVKKPGASVKVSCKASGYTFTNYWIHWVKQAPGQRLEWIGAIYPGNSDTHYNQKFQGKVTITRDTSASTAYMELSSLTSEDTAVYYCTRSSYYYDGSLFASWGQGTLVTVSSGGGGSGGGGSGGGGSDIVMTQTPLSLSVSPGQPASISCRSSQSIVHSNGNTYLYWYLQKPGQPPQLLIYRVSNRFSGVPDRFSGSGSGTDFTLKISRVEAEDVGVYYCFQGSTLPFTFGQGTKLEIK

SEQ ID NO: 90 - protein, 503 aa, artificial
  BCMA-9 HL x CD3 HL bispecific molecule
QVQLVQSGAEVKKPGASVKVSCKASGYTFTNYWIHWVKQAPGQRLEWIGAIYPGNSDTHYNQKFQGKVTITRDTSASTAYMELSSLTSEDTAVYYCTRSSYYYDGSLFASWGQGTLVTVSSGGGGSGGGGSGGGGSDIVMTQTPLSLSVSPGQPASISCRSSQSIVHSNGNTYLYWYLQKPGQPPQLLIYRVSNRFSGVPDRFSGSGSGTDFTLKISRVEAEDVGVYYCFQGSTLPFTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 91 - protein, 5 aa, artificial
  VH CDR1 of BCMA-10
NYWIH

SEQ ID NO: 92 - protein, 17 aa, artificial
  VH CDR2 of BCMA-10
AIYPGNSDTHYNQKFQG

SEQ ID NO: 93 - protein, 12 aa, artificial
  VH CDR3 of BCMA-10
SSYYYDGSLFAS

SEQ ID NO: 94 - protein, 16 aa, artificial
  VL CDR1 of BCMA-10
RSSQSIVHSNGNTYLY

SEQ ID NO: 95 - protein, 7 aa, artificial
  VL CDR2 of BCMA-10
RVSNRFS

SEQ ID NO: 96 - protein, 9 aa, artificial
  VL CDR3 of BCMA-10
FQGSHLPFT

SEQ ID NO: 97 - protein, 121 aa, artificial; identical to SEQ ID NO: 87
  VH of BCMA-10

SEQ ID NO: 98 - protein, 112 aa, artificial
  VL of BCMA-10
DIVMTQTPLSLSVSPGQPASISCRSSQSIVHSNGNTYLYWYLQKPGQPPQLLIYRVSNRFSGVPDRFSGSGSGTDFTLKISRVEAEDVGVYYCFQGSHLPFTFGQGTKLEIK

SEQ ID NO: 99 - protein, 248 aa, artificial
  BCMA-10 scFv
QVQLVQSGAEVKKPGASVKVSCKASGYTFTNYWIHWVKQAPGQRLEWIGAIYPGNSDTHYNQKFQGKVTITRDTSASTAYMELSSLTSEDTAVYYCTRSSYYYDGSLFASWGQGTLVTVSSGGGGSGGGGSGGGGSDIVMTQTPLSLSVSPGQPASISCRSSQSIVHSNGNTYLYWYLQKPGQPPQLLIYRVSNRFSGVPDRFSGSGSGTDFTLKISRVEAEDVGVYYCFQGSHLPFTFGQGTKLEIK

SEQ ID NO: 100 - protein, 503 aa, artificial
  BCMA-10 HL x CD3 HL bispecific molecule
QVQLVQSGAEVKKPGASVKVSCKASGYTFTNYWIHWVKQAPGQRLEWIGAIYPGNSDTHYNQKFQGKVTITRDTSASTAYMELSSLTSEDTAVYYCTRSSYYYDGSLFASWGQGTLVTVSSGGGGSGGGGSGGGGSDIVMTQTPLSLSVSPGQPASISCRSSQSIVHSNGNTYLYWYLQKPGQPPQLLIYRVSNRFSGVPDRFSGSGSGTDFTLKISRVEAEDVGVYYCFQGSHLPFTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 101 - protein, 5 aa, artificial
  VH CDR1 of BCMA-11
NYWIH

SEQ ID NO: 102 - protein, 17 aa, artificial
  VH CDR2 of BCMA-11
AIYPGNSDTHYNQKFQG

SEQ ID NO: 103 - protein, 12 aa, artificial
  VH CDR3 of BCMA-11
SSYYYDGSLFAS

SEQ ID NO: 104 - protein, 16 aa, artificial
  VL CDR1 of BCMA-11
KSSQSIVHSNGNTYLY

SEQ ID NO: 105 - protein, 7 aa, artificial
  VL CDR2 of BCMA-11
RVSNRFS

SEQ ID NO: 106 - protein, 9 aa, artificial
  VL CDR3 of BCMA-11
FQGSTLPFT

SEQ ID NO: 107 - protein, 121 aa, artificial; identical to SEQ ID NO: 87
  VH of BCMA-11

SEQ ID NO: 108 - protein, 112 aa, artificial
  VL of BCMA-11
DIVMTQTPLSLSVTPGQQASISCKSSQSIVHSNGNTYLYWYLQKPGQPPQLLIYRVSNRFSGVPDRFSGSGSGTDFTLKISRVEAEDVGVYYCFQGSTLPFTFGQGTKLEIK

SEQ ID NO: 109 - protein, 248 aa, artificial
  BCMA-11 scFv
QVQLVQSGAEVKKPGASVKVSCKASGYTFTNYWIHWVKQAPGQRLEWIGAIYPGNSDTHYNQKFQGKVTITRDTSASTAYMELSSLTSEDTAVYYCTRSSYYYDGSLFASWGQGTLVTVSSGGGGSGGGGSGGGGSDIVMTQTPLSLSVTPGQQASISCKSSQSIVHSNGNTYLYWYLQKPGQPPQLLIYRVSNRFSGVPDRFSGSGSGTDFTLKISRVEAEDVGVYYCFQGSTLPFTFGQGTKLEIK

SEQ ID NO: 110 - protein, 503 aa, artificial
  BCMA-11 HL x CD3 HL bispecific molecule
QVQLVQSGAEVKKPGASVKVSCKASGYTFTNYWIHWVKQAPGQRLEWIGAIYPGNSDTHYNQKFQGKVTITRDTSASTAYMELSSLTSEDTAVYYCTRSSYYYDGSLFASWGQGTLVTVSSGGGGSGGGGSGGGGSDIVMTQTPLSLSVTPGQQASISCKSSQSIVHSNGNTYLYWYLQKPGQPPQLLIYRVSNRFSGVPDRFSGSGSGTDFTLKISRVEAEDVGVYYCFQGSTLPFTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 111 - protein, 5 aa, artificial
  VH CDR1 of BCMA-12
NYWIH

SEQ ID NO: 112 - protein, 17 aa, artificial
  VH CDR2 of BCMA-12
AIYPGNSDTHYNQKFQG

SEQ ID NO: 113 - protein, 12 aa, artificial
  VH CDR3 of BCMA-12
SSYYYDGSLFAS

SEQ ID NO: 114 - protein, 16 aa, artificial
  VL CDR1 of BCMA-12
KSSQSIVHSNGNTYLY

SEQ ID NO: 115 - protein, 7 aa, artificial
  VL CDR2 of BCMA-12
RVSNRFS

SEQ ID NO: 116 - protein, 9 aa, artificial
  VL CDR3 of BCMA-12
FQGSHLPFT

SEQ ID NO: 117 - protein, 121 aa, artificial; identical to SEQ ID NO: 87
  VH of BCMA-12

SEQ ID NO: 118 - protein, 112 aa, artificial
  VL of BCMA-12
DIVMTQTPLSLSVTPGQQASISCKSSQSIVHSNGNTYLYWYLQKPGQPPQLLIYRVSNRFSGVPDRFSGSGSGTDFTLKISRVEAEDVGVYYCFQGSHLPFTFGQGTKLEIK

SEQ ID NO: 119 - protein, 248 aa, artificial
  BCMA-12 scFv
QVQLVQSGAEVKKPGASVKVSCKASGYTFTNYWIHWVKQAPGQRLEWIGAIYPGNSDTHYNQKFQGKVTITRDTSASTAYMELSSLTSEDTAVYYCTRSSYYYDGSLFASWGQGTLVTVSSGGGGSGGGGSGGGGSDIVMTQTPLSLSVTPGQQASISCKSSQSIVHSNGNTYLYWYLQKPGQPPQLLIYRVSNRFSGVPDRFSGSGSGTDFTLKISRVEAEDVGVYYCFQGSHLPFTFGQGTKLEIK

SEQ ID NO: 120 - protein, 503 aa, artificial
  BCMA-12 HL x CD3 HL bispecific molecule
QVQLVQSGAEVKKPGASVKVSCKASGYTFTNYWIHWVKQAPGQRLEWIGAIYPGNSDTHYNQKFQGKVTITRDTSASTAYMELSSLTSEDTAVYYCTRSSYYYDGSLFASWGQGTLVTVSSGGGGSGGGGSGGGGSDIVMTQTPLSLSVTPGQQASISCKSSQSIVHSNGNTYLYWYLQKPGQPPQLLIYRVSNRFSGVPDRFSGSGSGTDFTLKISRVEAEDVGVYYCFQGSHLPFTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 121 - protein, 5 aa, artificial
  VH CDR1 of BCMA-13
NYWIH

SEQ ID NO: 122 - protein, 17 aa, artificial
  VH CDR2 of BCMA-13
AIYPGNSDTHYNQKFQG

SEQ ID NO: 123 - protein, 12 aa, artificial
  VH CDR3 of BCMA-13
SSYYYDGSLFAS

SEQ ID NO: 124 - protein, 16 aa, artificial
  VL CDR1 of BCMA-13
KSSQSIVHSNGNTYLY

SEQ ID NO: 125 - protein, 7 aa, artificial
  VL CDR2 of BCMA-13
RVSNRFS

SEQ ID NO: 126 - protein, 9 aa, artificial
  VL CDR3 of BCMA-13
FQGSTLPFT

SEQ ID NO: 127 - protein, 121 aa, artificial
  VH of BCMA-13
QVQLVQSGAVVAKPGASVKVSCKASGYTFTNYWIHWVKQAPGQRLEWMGAIYPGNSDTHYNQKFQGRVTLTTDTSASTAYMELSSLRNEDTAVYYCTRSSYYYDGSLFASWGQGTLVTVSS

SEQ ID NO: 128 - protein, 112 aa, artificial; identical to SEQ ID NO: 108
  VL of BCMA-13

SEQ ID NO: 129 - protein, 248 aa, artificial
  BCMA-13 scFv
QVQLVQSGAVVAKPGASVKVSCKASGYTFTNYWIHWVKQAPGQRLEWMGAIYPGNSDTHYNQKFQGRVTLTTDTSASTAYMELSSLRNEDTAVYYCTRSSYYYDGSLFASWGQGTLVTVSSGGGGSGGGGSGGGGSDIVMTQTPLSLSVTPGQQASISCKSSQSIVHSNGNTYLYWYLQKPGQPPQLLIYRVSNRFSGVPDRFSGSGSGTDFTLKISRVEAEDVGVYYCFQGSTLPFTFGQGTKLEIK

SEQ ID NO: 130 - protein, 503 aa, artificial
  BCMA-13 HL x CD3 HL bispecific molecule
QVQLVQSGAVVAKPGASVKVSCKASGYTFTNYWIHWVKQAPGQRLEWMGAIYPGNSDTHYNQKFQGRVTLTTDTSASTAYMELSSLRNEDTAVYYCTRSSYYYDGSLFASWGQGTLVTVSSGGGGSGGGGSGGGGSDIVMTQTPLSLSVTPGQQASISCKSSQSIVHSNGNTYLYWYLQKPGQPPQLLIYRVSNRFSGVPDRFSGSGSGTDFTLKISRVEAEDVGVYYCFQGSTLPFTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 131 - protein, 5 aa, artificial
  VH CDR1 of BCMA-14
NYWIH

SEQ ID NO: 132 - protein, 17 aa, artificial
  VH CDR2 of BCMA-14
AIYPGNSDTHYNQKFQG

SEQ ID NO: 133 - protein, 12 aa, artificial
  VH CDR3 of BCMA-14
SSYYYDGSLFAS

SEQ ID NO: 134 - protein, 16 aa, artificial
  VL CDR1 of BCMA-14
KSSQSIVHSNGNTYLY

SEQ ID NO: 135 - protein, 7 aa, artificial
  VL CDR2 of BCMA-14
RVSNRFS

SEQ ID NO: 136 - protein, 9 aa, artificial
  VL CDR3 of BCMA-14
FQGSHLPFT

SEQ ID NO: 137 - protein, 121 aa, artificial; identical to SEQ ID NO: 127
  VH of BCMA-14

SEQ ID NO: 138 - protein, 112 aa, artificial; identical to SEQ ID NO: 118
  VL of BCMA-14

SEQ ID NO: 139 - protein, 248 aa, artificial
  BCMA-14 scFv
QVQLVQSGAVVAKPGASVKVSCKASGYTFTNYWIHWVKQAPGQRLEWMGAIYPGNSDTHYNQKFQGRVTLTTDTSASTAYMELSSLRNEDTAVYYCTRSSYYYDGSLFASWGQGTLVTVSSGGGGSGGGGSGGGGSDIVMTQTPLSLSVTPGQQASISCKSSQSIVHSNGNTYLYWYLQKPGQPPQLLIYRVSNRFSGVPDRFSGSGSGTDFTLKISRVEAEDVGVYYCFQGSHLPFTFGQGTKLEIK

SEQ ID NO: 140 - protein, 503 aa, artificial
  BCMA-14 HL x CD3 HL bispecific molecule
QVQLVQSGAVVAKPGASVKVSCKASGYTFTNYWIHWVKQAPGQRLEWMGAIYPGNSDTHYNQKFQGRVTLTTDTSASTAYMELSSLRNEDTAVYYCTRSSYYYDGSLFASWGQGTLVTVSSGGGGSGGGGSGGGGSDIVMTQTPLSLSVTPGQQASISCKSSQSIVHSNGNTYLYWYLQKPGQPPQLLIYRVSNRFSGVPDRFSGSGSGTDFTLKISRVEAEDVGVYYCFQGSHLPFTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 141 - protein, 5 aa, artificial
  VH CDR1 of BCMA-15
SYWIH

SEQ ID NO: 142 - protein, 17 aa, artificial
  VH CDR2 of BCMA-15
AIYPGNSDTHYNQKFQG

SEQ ID NO: 143 - protein, 12 aa, artificial
  VH CDR3 of BCMA-15
SSYYYDGSLFAD

SEQ ID NO: 144 - protein, 16 aa, artificial
  VL CDR1 of BCMA-15
KSSQSIVHSNGNTYLY

SEQ ID NO: 145 - protein, 7 aa, artificial
  VL CDR2 of BCMA-15
RVSNRFS

SEQ ID NO: 146 - protein, 9 aa, artificial
  VL CDR3 of BCMA-15
FQGSTLPFT

SEQ ID NO: 147 - protein, 121 aa, artificial
  VH of BCMA-15
QVQLVQSGAEVKKPGTSVKVSCKASGYTFTSYWIHWVKQAPGQRLEWIGAIYPGNSDTHYNQKFQGRVTLTRDTSASTAYMELSSLRSEDSAVYYCTRSSYYYDGSLFADWGQGTLVTVSS

SEQ ID NO: 148 - protein, 112 aa, artificial
  VL of BCMA-15
DIVMTQTPLSLSVTPGQPASISCKSSQSIVHSNGNTYLYWYLQKPGQPPQLLIYRVSNRFSGVPDRFSGSGSGTDFTLKISRVEAEDVGVYYCFQGSTLPFTFGQGTKLEIK

SEQ ID NO: 149 - protein, 248 aa, artificial
  BCMA-15 scFv
QVQLVQSGAEVKKPGTSVKVSCKASGYTFTSYWIHWVKQAPGQRLEWIGAIYPGNSDTHYNQKFQGRVTLTRDTSASTAYMELSSLRSEDSAVYYCTRSSYYYDGSLFADWGQGTLVTVSSGGGGSGGGGSGGGGSDIVMTQTPLSLSVTPGQPASISCKSSQSIVHSNGNTYLYWYLQKPGQPPQLLIYRVSNRFSGVPDRFSGSGSGTDFTLKISRVEAEDVGVYYCFQGSTLPFTFGQGTKLEIK

SEQ ID NO: 150 - protein, 503 aa, artificial
  BCMA-15 HL x CD3 HL bispecific molecule
QVQLVQSGAEVKKPGTSVKVSCKASGYTFTSYWIHWVKQAPGQRLEWIGAIYPGNSDTHYNQKFQGRVTLTRDTSASTAYMELSSLRSEDSAVYYCTRSSYYYDGSLFADWGQGTLVTVSSGGGGSGGGGSGGGGSDIVMTQTPLSLSVTPGQPASISCKSSQSIVHSNGNTYLYWYLQKPGQPPQLLIYRVSNRFSGVPDRFSGSGSGTDFTLKISRVEAEDVGVYYCFQGSTLPFTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 151 - protein, 5 aa, artificial
  VH CDR1 of BCMA-16
SYWIH

SEQ ID NO: 152 - protein, 17 aa, artificial
  VH CDR2 of BCMA-16
AIYPGNSDTHYNQKFQG

SEQ ID NO: 153 - protein, 12 aa, artificial
  VH CDR3 of BCMA-16
SSYYYDGSLFAD

SEQ ID NO: 154 - protein, 16 aa, artificial
  VL CDR1 of BCMA-16
KSSQSIVHSNGNTYLY

SEQ ID NO: 155 - protein, 7 aa, artificial
  VL CDR2 of BCMA-16
RVSNRFS

SEQ ID NO: 156 - protein, 9 aa, artificial
  VL CDR3 of BCMA-16
FQGSHLPFT

SEQ ID NO: 157 - protein, 121 aa, artificial; identical to SEQ ID NO: 147
  VH of BCMA-16

SEQ ID NO: 158 - protein, 112 aa, artificial
  VL of BCMA-16
DIVMTQTPLSLSVTPGQPASISCKSSQSIVHSNGNTYLYWYLQKPGQPPQLLIYRVSNRFSGVPDRFSGSGSGTDFTLKISRVEAEDVGVYYCFQGSHLPFTFGQGTKLEIK

SEQ ID NO: 159 - protein, 248 aa, artificial
  BCMA-16 scFv
QVQLVQSGAEVKKPGTSVKVSCKASGYTFTSYWIHWVKQAPGQRLEWIGAIYPGNSDTHYNQKFQGRVTLTRDTSASTAYMELSSLRSEDSAVYYCTRSSYYYDGSLFADWGQGTLVTVSSGGGGSGGGGSGGGGSDIVMTQTPLSLSVTPGQPASISCKSSQSIVHSNGNTYLYWYLQKPGQPPQLLIYRVSNRFSGVPDRFSGSGSGTDFTLKISRVEAEDVGVYYCFQGSHLPFTFGQGTKLEIK

SEQ ID NO: 160 - protein, 503 aa, artificial
  BCMA-16 HL x CD3 HL bispecific molecule
QVQLVQSGAEVKKPGTSVKVSCKASGYTFTSYWIHWVKQAPGQRLEWIGAIYPGNSDTHYNQKFQGRVTLTRDTSASTAYMELSSLRSEDSAVYYCTRSSYYYDGSLFADWGQGTLVTVSSGGGGSGGGGSGGGGSDIVMTQTPLSLSVTPGQPASISCKSSQSIVHSNGNTYLYWYLQKPGQPPQLLIYRVSNRFSGVPDRFSGSGSGTDFTLKISRVEAEDVGVYYCFQGSHLPFTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 161 - protein, 5 aa, artificial
  VH CDR1 of BCMA-17
NFDMA

SEQ ID NO: 162 - protein, 17 aa, artificial
  VH CDR2 of BCMA-17
SITTGADHAIYADSVKG

SEQ ID NO: 163 - protein, 12 aa, artificial
  VH CDR3 of BCMA-17
HGYYDGYHLFDY

SEQ ID NO: 164 - protein, 11 aa, artificial
  VL CDR1 of BCMA-17
RASQGISNYLN

SEQ ID NO: 165 - protein, 7 aa, artificial
  VL CDR2 of BCMA-17
YTSNLQS

SEQ ID NO: 166 - protein, 9 aa, artificial
  VL CDR3 of BCMA-17
QQYDISSYT

SEQ ID NO: 167 - protein, 121 aa, artificial
  VH of BCMA-17
EVQLVESGGGLVQPGGSLRLSCAASGFTFSNFDMAWVRQAPGKGLVWVSSITTGADHAIYADSVKGRFTISRDNAKNTLYLQMDSLRAEDTAVYYCVRHGYYDGYHLFDYWGQGTLVTVSS

SEQ ID NO: 168 - protein, 107 aa, artificial
  VL of BCMA-17
DIQMTQSPSSLSASVGDRVTITCRASQGISNYLNWYQQKPGKAPKPLIYYTSNLQSGVPSRFSGSGSGTDYTLTISSLQPEDFATYYCQQYDISSYTFGQGTKLEIK

SEQ ID NO: 169 - protein, 243 aa, artificial
  BCMA-17 scFv
EVQLVESGGGLVQPGGSLRLSCAASGFTFSNFDMAWVRQAPGKGLVWVSSITTGADHAIYADSVKGRFTISRDNAKNTLYLQMDSLRAEDTAVYYCVRHGYYDGYHLFDYWGQGTLVTVSSGGGGSGGGGSGGGGSDIQMTQSPSSLSASVGDRVTITCRASQGISNYLNWYQQKPGKAPKPLIYYTSNLQSGVPSRFSGSGSGTDYTLTISSLQPEDFATYYCQQYDISSYTFGQGTKLEIK

SEQ ID NO: 170 - protein, 498 aa, artificial
  BCMA-17 HL x CD3 HL bispecific molecule
EVQLVESGGGLVQPGGSLRLSCAASGFTFSNFDMAWVRQAPGKGLVWVSSITTGADHAIYADSVKGRFTISRDNAKNTLYLQMDSLRAEDTAVYYCVRHGYYDGYHLFDYWGQGTLVTVSSGGGGSGGGGSGGGGSDIQMTQSPSSLSASVGDRVTITCRASQGISNYLNWYQQKPGKAPKPLIYYTSNLQSGVPSRFSGSGSGTDYTLTISSLQPEDFATYYCQQYDISSYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 171 - protein, 5 aa, artificial
  VH CDR1 of BCMA-18
NFDMA

SEQ ID NO: 172 - protein, 17 aa, artificial
  VH CDR2 of BCMA-18
SITTGADHAIYADSVKG

SEQ ID NO: 173 - protein, 12 aa, artificial
  VH CDR3 of BCMA-18
HGYYDGYHLFDY

SEQ ID NO: 174 - protein, 11 aa, artificial
  VL CDR1 of BCMA-18
RASQGISNYLN

SEQ ID NO: 175 - protein, 7 aa, artificial
  VL CDR2 of BCMA-18
YTSNLQS

SEQ ID NO: 176 - protein, 9 aa, artificial
  VL CDR3 of BCMA-18
MGQTISSYT

SEQ ID NO: 177 - protein, 121 aa, artificial; identical to SEQ ID NO: 167
  VH of BCMA-18

SEQ ID NO: 178 - protein, 107 aa, artificial
  VL of BCMA-18
DIQMTQSPSSLSASVGDRVTITCRASQGISNYLNWYQQKPGKAPKPLIYYTSNLQSGVPSRFSGSGSGTDYTLTISSLQPEDFATYYCMGQTISSYTFGQGTKLEIK

SEQ ID NO: 179 - protein, 243 aa, artificial
  BCMA-18 scFv
EVQLVESGGGLVQPGGSLRLSCAASGFTFSNFDMAWVRQAPGKGLVWVSSITTGADHAIYADSVKGRFTISRDNAKNTLYLQMDSLRAEDTAVYYCVRHGYYDGYHLFDYWGQGTLVTVSSGGGGSGGGGSGGGGSDIQMTQSPSSLSASVGDRVTITCRASQGISNYLNWYQQKPGKAPKPLIYYTSNLQSGVPSRFSGSGSGTDYTLTISSLQPEDFATYYCMGQTISSYTFGQGTKLEIK

SEQ ID NO: 180 - protein, 498 aa, artificial
  BCMA-18 HL x CD3 HL bispecific molecule
EVQLVESGGGLVQPGGSLRLSCAASGFTFSNFDMAWVRQAPGKGLVWVSSITTGADHAIYADSVKGRFTISRDNAKNTLYLQMDSLRAEDTAVYYCVRHGYYDGYHLFDYWGQGTLVTVSSGGGGSGGGGSGGGGSDIQMTQSPSSLSASVGDRVTITCRASQGISNYLNWYQQKPGKAPKPLIYYTSNLQSGVPSRFSGSGSGTDYTLTISSLQPEDFATYYCMGQTISSYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 181 - protein, 5 aa, artificial
  VH CDR1 of BCMA-19
NFDMA

SEQ ID NO: 182 - protein, 17 aa, artificial
  VH CDR2 of BCMA-19
SITTGADHAIYADSVKG

SEQ ID NO: 183 - protein, 12 aa, artificial
  VH CDR3 of BCMA-19
HGYYDGYHLFDY

SEQ ID NO: 184 - protein, 11 aa, artificial
  VL CDR1 of BCMA-19
RASQGISNYLN

SEQ ID NO: 185 - protein, 7 aa, artificial
  VL CDR2 of BCMA-19
YTSNLQS

SEQ ID NO: 186 - protein, 9 aa, artificial
  VL CDR3 of BCMA-19
QQYDISSYT

SEQ ID NO: 187 - protein, 121 aa, artificial
  VH of BCMA-19
EVQLVESGGGLVQPGGSLRLSCAASGFTFSNFDMAWVRQAPGKGLVWVSSITTGADHAIYADSVKGRFTISRDNAKNTLYLQMNSLRAEDTAVYYCVRHGYYDGYHLFDYWGQGTLVTVSS

SEQ ID NO: 188 - protein, 107 aa, artificial; identical to SEQ ID NO: 168
  VL of BCMA-19

SEQ ID NO: 189 - protein, 243 aa, artificial
  BCMA-19 scFv
EVQLVESGGGLVQPGGSLRLSCAASGFTFSNFDMAWVRQAPGKGLVWVSSITTGADHAIYADSVKGRFTISRDNAKNTLYLQMNSLRAEDTAVYYCVRHGYYDGYHLFDYWGQGTLVTVSSGGGGSGGGGSGGGGSDIQMTQSPSSLSASVGDRVTITCRASQGISNYLNWYQQKPGKAPKPLIYYTSNLQSGVPSRFSGSGSGTDYTLTISSLQPEDFATYYCQQYDISSYTFGQGTKLEIK

SEQ ID NO: 190 - protein, 498 aa, artificial
  BCMA-19 HL x CD3 HL bispecific molecule
EVQLVESGGGLVQPGGSLRLSCAASGFTFSNFDMAWVRQAPGKGLVWVSSITTGADHAIYADSVKGRFTISRDNAKNTLYLQMNSLRAEDTAVYYCVRHGYYDGYHLFDYWGQGTLVTVSSGGGGSGGGGSGGGGSDIQMTQSPSSLSASVGDRVTITCRASQGISNYLNWYQQKPGKAPKPLIYYTSNLQSGVPSRFSGSGSGTDYTLTISSLQPEDFATYYCQQYDISSYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 191 - protein, 5 aa, artificial
  VH CDR1 of BCMA-20
NFDMA

SEQ ID NO: 192 - protein, 17 aa, artificial
  VH CDR2 of BCMA-20
SITTGADHAIYADSVKG

SEQ ID NO: 193 - protein, 12 aa, artificial
  VH CDR3 of BCMA-20
HGYYDGYHLFDY

SEQ ID NO: 194 - protein, 11 aa, artificial
  VL CDR1 of BCMA-20
RASQGISNYLN

SEQ ID NO: 195 - protein, 7 aa, artificial
  VL CDR2 of BCMA-20
YTSNLQS

SEQ ID NO: 196 - protein, 9 aa, artificial
  VL CDR3 of BCMA-20
MGQTISSYT

SEQ ID NO: 197 - protein, 121 aa, artificial; identical to SEQ ID NO: 187
  VH of BCMA-20

SEQ ID NO: 198 - protein, 107 aa, artificial; identical to SEQ ID NO: 178
  VL of BCMA-20

SEQ ID NO: 199 - protein, 243 aa, artificial
  BCMA-20 scFv
EVQLVESGGGLVQPGGSLRLSCAASGFTFSNFDMAWVRQAPGKGLVWVSSITTGADHAIYADSVKGRFTISRDNAKNTLYLQMNSLRAEDTAVYYCVRHGYYDGYHLFDYWGQGTLVTVSSGGGGSGGGGSGGGGSDIQMTQSPSSLSASVGDRVTITCRASQGISNYLNWYQQKPGKAPKPLIYYTSNLQSGVPSRFSGSGSGTDYTLTISSLQPEDFATYYCMGQTISSYTFGQGTKLEIK

SEQ ID NO: 200 - protein, 498 aa, artificial
  BCMA-20 HL x CD3 HL bispecific molecule
EVQLVESGGGLVQPGGSLRLSCAASGFTFSNFDMAWVRQAPGKGLVWVSSITTGADHAIYADSVKGRFTISRDNAKNTLYLQMNSLRAEDTAVYYCVRHGYYDGYHLFDYWGQGTLVTVSSGGGGSGGGGSGGGGSDIQMTQSPSSLSASVGDRVTITCRASQGISNYLNWYQQKPGKAPKPLIYYTSNLQSGVPSRFSGSGSGTDYTLTISSLQPEDFATYYCMGQTISSYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 201 - protein, 5 aa, artificial
  VH CDR1 of BCMA-21
NFDMA

SEQ ID NO: 202 - protein, 17 aa, artificial
  VH CDR2 of BCMA-21
SITTGADHAIYADSVKG

SEQ ID NO: 203 - protein, 12 aa, artificial
  VH CDR3 of BCMA-21
HGYYDGYHLFDY

SEQ ID NO: 204 - protein, 11 aa, artificial
  VL CDR1 of BCMA-21
RASQGISNYLN

SEQ ID NO: 205 - protein, 7 aa, artificial
  VL CDR2 of BCMA-21
YTSNLQS

SEQ ID NO: 206 - protein, 9 aa, artificial
  VL CDR3 of BCMA-21
QQYDISSYT

SEQ ID NO: 207 - protein, 121 aa, artificial
  VH of BCMA-21
EVQLVESGGGLVQPGGSLRLSCAASGFTFSNFDMAWVRQAPGKGLVWVSSITTGADHAIYADSVKGRFTISRDNAKNTLYLQMDSLRSEDTAVYYCVRHGYYDGYHLFDYWGQGTLVTVSS

SEQ ID NO: 208 - protein, 107 aa, artificial
  VL of BCMA-21
DIQMTQSPSSLSASVGDRVTISCRASQGISNYLNWYQQKPGKAPKPLIYYTSNLQSGVPSRFSGSGSGTDYTLTISSLQPEDFATYYCQQYDISSYTFGQGTKLEIK

SEQ ID NO: 209 - protein, 243 aa, artificial
  BCMA-21 scFv
EVQLVESGGGLVQPGGSLRLSCAASGFTFSNFDMAWVRQAPGKGLVWVSSITTGADHAIYADSVKGRFTISRDNAKNTLYLQMDSLRSEDTAVYYCVRHGYYDGYHLFDYWGQGTLVTVSSGGGGSGGGGSGGGGSDIQMTQSPSSLSASVGDRVTISCRASQGISNYLNWYQQKPGKAPKPLIYYTSNLQSGVPSRFSGSGSGTDYTLTISSLQPEDFATYYCQQYDISSYTFGQGTKLEIK

SEQ ID NO: 210 - protein, 498 aa, artificial
  BCMA-21 HL x CD3 HL bispecific molecule
EVQLVESGGGLVQPGGSLRLSCAASGFTFSNFDMAWVRQAPGKGLVWVSSITTGADHAIYADSVKGRFTISRDNAKNTLYLQMDSLRSEDTAVYYCVRHGYYDGYHLFDYWGQGTLVTVSSGGGGSGGGGSGGGGSDIQMTQSPSSLSASVGDRVTISCRASQGISNYLNWYQQKPGKAPKPLIYYTSNLQSGVPSRFSGSGSGTDYTLTISSLQPEDFATYYCQQYDISSYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 211 - protein, 5 aa, artificial
  VH CDR1 of BCMA-22
NFDMA

SEQ ID NO: 212 - protein, 17 aa, artificial
  VH CDR2 of BCMA-22
SITTGADHAIYAESVKG

SEQ ID NO: 213 - protein, 12 aa, artificial
  VH CDR3 of BCMA-22
HGYYDGYHLFDY

SEQ ID NO: 214 - protein, 11 aa, artificial
  VL CDR1 of BCMA-22
RASQGISNYLN

SEQ ID NO: 215 - protein, 7 aa, artificial
  VL CDR2 of BCMA-22
YTSNLQS

SEQ ID NO: 216 - protein, 9 aa, artificial
  VL CDR3 of BCMA-22
MGQTISSYT

SEQ ID NO: 217 - protein, 121 aa, artificial
  VH of BCMA-22
EVQLVESGGGLVQPGGSLRLSCAASGFTFSNFDMAWVRQAPGKGLVWVSSITTGADHAIYAESVKGRFTISRDNAKNTLYLQMDSLRSEDTAVYYCVRHGYYDGYHLFDYWGQGTLVTVSS

SEQ ID NO: 218 - protein, 107 aa, artificial
  VL of BCMA-22
DIQMTQSPSSLSASVGDRVTISCRASQGISNYLNWYQQKPGKAPKPLIYYTSNLQSGVPSRFSGSGSGTDYTLTISSLQPEDFATYYCMGQTISSYTFGQGTKLEIK

SEQ ID NO: 219 - protein, 243 aa, artificial
  BCMA-22 scFv
EVQLVESGGGLVQPGGSLRLSCAASGFTFSNFDMAWVRQAPGKGLVWVSSITTGADHAIYAESVKGRFTISRDNAKNTLYLQMDSLRSEDTAVYYCVRHGYYDGYHLFDYWGQGTLVTVSSGGGGSGGGGSGGGGSDIQMTQSPSSLSASVGDRVTISCRASQGISNYLNWYQQKPGKAPKPLIYYTSNLQSGVPSRFSGSGSGTDYTLTISSLQPEDFATYYCMGQTISSYTFGQGTKLEIK

SEQ ID NO: 220 - protein, 498 aa, artificial
  BCMA-22 HL x CD3 HL bispecific molecule
EVQLVESGGGLVQPGGSLRLSCAASGFTFSNFDMAWVRQAPGKGLVWVSSITTGADHAIYAESVKGRFTISRDNAKNTLYLQMDSLRSEDTAVYYCVRHGYYDGYHLFDYWGQGTLVTVSSGGGGSGGGGSGGGGSDIQMTQSPSSLSASVGDRVTISCRASQGISNYLNWYQQKPGKAPKPLIYYTSNLQSGVPSRFSGSGSGTDYTLTISSLQPEDFATYYCMGQTISSYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 221 - protein, 5 aa, artificial
  VH CDR1 of BCMA-23
NFDMA

SEQ ID NO: 222 - protein, 17 aa, artificial
  VH CDR2 of BCMA-23
SITTGADHAIYADSVKG

SEQ ID NO: 223 - protein, 12 aa, artificial
  VH CDR3 of BCMA-23
HGYYDGYHLFDY

SEQ ID NO: 224 - protein, 11 aa, artificial
  VL CDR1 of BCMA-23
RASQGISNYLN

SEQ ID NO: 225 - protein, 7 aa, artificial
  VL CDR2 of BCMA-23
YTSNLQS

SEQ ID NO: 226 - protein, 9 aa, artificial
  VL CDR3 of BCMA-23
MGQTISSYT

SEQ ID NO: 227 - protein, 121 aa, artificial
  VH of BCMA-23
EVQLVESGGGLVQPGRSLRLSCAASGFTFSNFDMAWVRQAPAKGLEWVSSITTGADHAIYADSVKGRFTISRDNAKNTLYLQMNSLRAEDTAVYYCVRHGYYDGYHLFDYWGQGTLVTVSS

SEQ ID NO: 228 - protein, 107 aa, artificial
  VL of BCMA-23
DIQMTQSPSSLSASVGDRVTITCRASQGISNYLNWYQQKPGKAPKPLIYYTSNLQSGVPSRFSGSGSGTDFTLTISSLQPEDFATYYCMGQTISSYTFGQGTKLEIK

SEQ ID NO: 229 - protein, 243 aa, artificial
  BCMA-23 scFv
EVQLVESGGGLVQPGRSLRLSCAASGFTFSNFDMAWVRQAPAKGLEWVSSITTGADHAIYADSVKGRFTISRDNAKNTLYLQMNSLRAEDTAVYYCVRHGYYDGYHLFDYWGQGTLVTVSSGGGGSGGGGSGGGGSDIQMTQSPSSLSASVGDRVTITCRASQGISNYLNWYQQKPGKAPKPLIYYTSNLQSGVPSRFSGSGSGTDFTLTISSLQPEDFATYYCMGQTISSYTFGQGTKLEIK

SEQ ID NO: 230 - protein, 498 aa, artificial
  BCMA-23 HL x CD3 HL bispecific molecule
EVQLVESGGGLVQPGRSLRLSCAASGFTFSNFDMAWVRQAPAKGLEWVSSITTGADHAIYADSVKGRFTISRDNAKNTLYLQMNSLRAEDTAVYYCVRHGYYDGYHLFDYWGQGTLVTVSSGGGGSGGGGSGGGGSDIQMTQSPSSLSASVGDRVTITCRASQGISNYLNWYQQKPGKAPKPLIYYTSNLQSGVPSRFSGSGSGTDFTLTISSLQPEDFATYYCMGQTISSYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 231 - protein, 5 aa, artificial
  VH CDR1 of BCMA-24
DYYIN

SEQ ID NO: 232 - protein, 17 aa, artificial
  VH CDR2 of BCMA-24
WIYFASGNSEYNQKFTG

SEQ ID NO: 233 - protein, 10 aa, artificial
  VH CDR3 of BCMA-24
LYDYDWYFDV

SEQ ID NO: 234 - protein, 16 aa, artificial
  VL CDR1 of BCMA-24
KSSQSLVHSNGNTYLH

SEQ ID NO: 235 - protein, 7 aa, artificial
  VL CDR2 of BCMA-24
KVSNRFS

SEQ ID NO: 236 - protein, 9 aa, artificial
  VL CDR3 of BCMA-24
AETSHVPWT

SEQ ID NO: 237 - protein, 119 aa, artificial
  VH of BCMA-24
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSS

SEQ ID NO: 238 - protein, 112 aa, artificial
  VL of BCMA-24
DIVMTQTPLSLSVTPGQPASISCKSSQSLVHSNGNTYLHWYLQKPGQSPQLLIYKVSNRFSGVPDRFSGSGSGTDFTLKINRVEAEDVGVYYCAETSHVPWTFGQGTKLEIK

SEQ ID NO: 239 - protein, 246 aa, artificial
  BCMA-24 scFv
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKINRVEAEDVGVYYCAETSHVPWTFGQGTKLEIK

SEQ ID NO: 240 - protein, 501 aa, artificial
  BCMA-24 HL x CD3 HL bispecific molecule
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKINRVEAEDVGVYYCAETSHVPWTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 241 - protein, 5 aa, artificial
  VH CDR1 of BCMA-25
DYYIN

SEQ ID NO: 242 - protein, 17 aa, artificial
  VH CDR2 of BCMA-25
WIYFASGNSEYNQKFTG

SEQ ID NO: 243 - protein, 10 aa, artificial
  VH CDR3 of BCMA-25
LYDYDWYFDV

SEQ ID NO: 244 - protein, 16 aa, artificial
  VL CDR1 of BCMA-25
KSSQSLVHSNGNTYLH

SEQ ID NO: 245 - protein, 7 aa, artificial
  VL CDR2 of BCMA-25
KVSNRFS

SEQ ID NO: 246 - protein, 9 aa, artificial
  VL CDR3 of BCMA-25
LTTSHVPWT

SEQ ID NO: 247 - protein, 119 aa, artificial; identical to SEQ ID NO: 237
  VH of BCMA-25

SEQ ID NO: 248 - protein, 112 aa, artificial
  VL of BCMA-25
DIVMTQTPLSLSVTPGQPASISCKSSQSLVHSNGNTYLHWYLQKPGQSPQLLIYKVSNRFSGVPDRFSGSGSGTDFTLKINRVEAEDVGVYYCLTTSHVPWTFGQGTKLEIK

SEQ ID NO: 249 - protein, 246 aa, artificial
  BCMA-25 scFv
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKINRVEAEDVGVYYCLTTSHVPWTFGQGTKLEIK

SEQ ID NO: 250 - protein, 501 aa, artificial
  BCMA-25 HL x CD3 HL bispecific molecule
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKINRVEAEDVGVYYCLTTSHVPWTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 251 - protein, 5 aa, artificial
  VH CDR1 of BCMA-26
DYYIN

SEQ ID NO: 252 - protein, 17 aa, artificial
  VH CDR2 of BCMA-26
WIYFASGNSEYNQKFTG

SEQ ID NO: 253 - protein, 10 aa, artificial
  VH CDR3 of BCMA-26
LYDYDWYFDV

SEQ ID NO: 254 - protein, 16 aa, artificial
  VL CDR1 of BCMA-26
KSSQSLVHSNGNTYLH

SEQ ID NO: 255 - protein, 7 aa, artificial
  VL CDR2 of BCMA-26
KVSNRFS

SEQ ID NO: 256 - protein, 9 aa, artificial
  VL CDR3 of BCMA-26
AETSHVPWT

SEQ ID NO: 257 - protein, 119 aa, artificial; identical to SEQ ID NO: 237
  VH of BCMA-26

SEQ ID NO: 258 - protein, 112 aa, artificial
  VL of BCMA-26
DIVMTQTPLSLSVTPGQPASISCKSSQSLVHSNGNTYLHWYLQKPGQSPQLLIYKVSNRFSGVPDRFSGSGSGTDFTLKISRVEAEDVGVYYCAETSHVPWTFGQGTKLEIK

SEQ ID NO: 259 - protein, 246 aa, artificial
  BCMA-26 scFv
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGVYYCAETSHVPWTFGQGTKLEIK

SEQ ID NO: 260 - protein, 501 aa, artificial
  BCMA-26 HL x CD3 HL bispecific molecule
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGVYYCAETSHVPWTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 261 - protein, 5 aa, artificial
  VH CDR1 of BCMA-27
DYYIN

SEQ ID NO: 262 - protein, 17 aa, artificial
  VH CDR2 of BCMA-27
WIYFASGNSEYNQKFTG

SEQ ID NO: 263 - protein, 10 aa, artificial
  VH CDR3 of BCMA-27
LYDYDWYFDV

SEQ ID NO: 264 - protein, 16 aa, artificial
  VL CDR1 of BCMA-27
KSSQSLVHSNGNTYLH

SEQ ID NO: 265 - protein, 7 aa, artificial
  VL CDR2 of BCMA-27
KVSNRFS

SEQ ID NO: 266 - protein, 9 aa, artificial
  VL CDR3 of BCMA-27
LTTSHVPWT

SEQ ID NO: 267 - protein, 119 aa, artificial; identical to SEQ ID NO: 237
  VH of BCMA-27

SEQ ID NO: 268 - protein, 112 aa, artificial
  VL of BCMA-27
DIVMTQTPLSLSVTPGQPASISCKSSQSLVHSNGNTYLHWYLQKPGQSPQLLIYKVSNRFSGVPDRFSGSGSGTDFTLKISRVEAEDVGVYYCLTTSHVPWTFGQGTKLEIK

SEQ ID NO: 269 - protein, 246 aa, artificial
  BCMA-27 scFv
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGVYYCLTTSHVPWTFGQGTKLEIK

SEQ ID NO: 270 - protein, 501 aa, artificial
  BCMA-27 HL x CD3 HL bispecific molecule
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGVYYCLTTSHVPWTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 271 - protein, 5 aa, artificial
  VH CDR1 of BCMA-28
DYYIN

SEQ ID NO: 272 - protein, 17 aa, artificial
  VH CDR2 of BCMA-28
WIYFASGNSEYNQKFTG

SEQ ID NO: 273 - protein, 10 aa, artificial
  VH CDR3 of BCMA-28
LYDYDWYFDV

SEQ ID NO: 274 - protein, 16 aa, artificial
  VL CDR1 of BCMA-28
KSSQSLVHSNGNTYLH

SEQ ID NO: 275 - protein, 7 aa, artificial
  VL CDR2 of BCMA-28
KVSNRFS

SEQ ID NO: 276 - protein, 9 aa, artificial
  VL CDR3 of BCMA-28
AETSHVPWT

SEQ ID NO: 277 - protein, 119 aa, artificial; identical to SEQ ID NO: 237
  VH of BCMA-28

SEQ ID NO: 278 - protein, 112 aa, artificial
  VL of BCMA-28
DIVMTQTPLSLSVSPGQPASISCKSSQSLVHSNGNTYLHWYLQKPGQSPQLLIYKVSNRFSGVPDRFSGSGSGTDFTLKISRVEAEDVGVYYCAETSHVPWTFGQGTKLEIK

SEQ ID NO: 279 - protein, 246 aa, artificial
  BCMA-28 scFv
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVSPGQPASISCKSSQSLVHSNGNTYLHWYLQKPGQSPQLLIYKVSNRFSGVPDRFSGSGSGTDFTLKISRVEAEDVGVYYCAETSHVPWTFGQGTKLEIK

SEQ ID NO: 280 - protein, 501 aa, artificial
  BCMA-28 HL x CD3 HL bispecific molecule
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVSPGQPASISCKSSQSLVHSNGNTYLHWYLQKPGQSPQLLIYKVSNRFSGVPDRFSGSGSGTDFTLKISRVEAEDVGVYYCAETSHVPWTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 281 - protein, 5 aa, artificial
  VH CDR1 of BCMA-29
DYYIN

SEQ ID NO: 282 - protein, 17 aa, artificial
  VH CDR2 of BCMA-29
WIYFASGNSEYNQKFTG

SEQ ID NO: 283 - protein, 10 aa, artificial
  VH CDR3 of BCMA-29
LYDYDWYFDV

SEQ ID NO: 284 - protein, 16 aa, artificial
  VL CDR1 of BCMA-29
KSSQSLVHSNGNTYLH

SEQ ID NO: 285 - protein, 7 aa, artificial
  VL CDR2 of BCMA-29
KVSNRFS

SEQ ID NO: 286 - protein, 9 aa, artificial
  VL CDR3 of BCMA-29
LTTSHVPWT

SEQ ID NO: 287 - protein, 119 aa, artificial; identical to SEQ ID NO: 237
  VH of BCMA-29

SEQ ID NO: 288 - protein, 112 aa, artificial
  VL of BCMA-29
DIVMTQTPLSLSVSPGQPASISCKSSQSLVHSNGNTYLHWYLQKPGQSPQLLIYKVSNRFSGVPDRFSGSGSGTDFTLKISRVEAEDVGVYYCLTTSHVPWTFGQGTKLEIK

SEQ ID NO: 289 - protein, 246 aa, artificial
  BCMA-29 scFv
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVSPGQPASISCKSSQSLVHSNGNTYLHWYLQKPGQSPQLLIYKVSNRFSGVPDRFSGSGSGTDFTLKISRVEAEDVGVYYCLTTSHVPWTFGQGTKLEIK

SEQ ID NO: 290 - protein, 501 aa, artificial
  BCMA-29 HL x CD3 HL bispecific molecule
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVSPGQPASISCKSSQSLVHSNGNTYLHWYLQKPGQSPQLLIYKVSNRFSGVPDRFSGSGSGTDFTLKISRVEAEDVGVYYCLTTSHVPWTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 291 - protein, 5 aa, artificial
  VH CDR1 of BCMA-30
DYYIN

SEQ ID NO: 292 - protein, 17 aa, artificial
  VH CDR2 of BCMA-30
WIYFASGNSEYNQKFTG

SEQ ID NO: 293 - protein, 10 aa, artificial
  VH CDR3 of BCMA-30
LYDYDWYFDV

SEQ ID NO: 294 - protein, 16 aa, artificial
  VL CDR1 of BCMA-30
KSSQSLVHSNGNTYLH

SEQ ID NO: 295 - protein, 7 aa, artificial
  VL CDR2 of BCMA-30
KVSNRFS

SEQ ID NO: 296 - protein, 9 aa, artificial
  VL CDR3 of BCMA-30
AETSHVPWT

SEQ ID NO: 297 - protein, 119 aa, artificial; identical to SEQ ID NO: 237
  VH of BCMA-30

SEQ ID NO: 298 - protein, 112 aa, artificial
  VL of BCMA-30
DIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIK

SEQ ID NO: 299 - protein, 246 aa, artificial
  BCMA-30 scFv
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIK

SEQ ID NO: 300 - protein, 501 aa, artificial
  BCMA-30 HL x CD3 HL bispecific molecule
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 301 - protein, 5 aa, artificial
  VH CDR1 of BCMA-31
DYYIN

SEQ ID NO: 302 - protein, 17 aa, artificial
  VH CDR2 of BCMA-31
WIYFASGNSEYNQKFTG

SEQ ID NO: 303 - protein, 10 aa, artificial
  VH CDR3 of BCMA-31
LYDYDWYFDV

SEQ ID NO: 304 - protein, 16 aa, artificial
  VL CDR1 of BCMA-31
KSSQSLVHSNGNTYLH

SEQ ID NO: 305 - protein, 7 aa, artificial
  VL CDR2 of BCMA-31
KVSNRFS

SEQ ID NO: 306 - protein, 9 aa, artificial
  VL CDR3 of BCMA-31
LTTSHVPWT

SEQ ID NO: 307 - protein, 119 aa, artificial; identical to SEQ ID NO: 237
  VH of BCMA-31

SEQ ID NO: 308 - protein, 112 aa, artificial
  VL of BCMA-31
DIVMTQTPLSLSVTPGEPASISCKSSQSLVHSNGNTYLHWYLQKPGQSPQLLIYKVSNRFSGVPDRFSGSGSGADFTLKISRVEAEDVGVYYCLTTSHVPWTFGQGTKLEIK

SEQ ID NO: 309 - protein, 246 aa, artificial
  BCMA-31 scFv
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCLTTSHVPWTFGQGTKLEIK

SEQ ID NO: 310 - protein, 501 aa, artificial
  BCMA-31 HL x CD3 HL bispecific molecule
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCLTTSHVPWTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 311 - protein, 5 aa, artificial
  VH CDR1 of BCMA-32
NHIIH

SEQ ID NO: 312 - protein, 17 aa, artificial
  VH CDR2 of BCMA-32
YINPYPGYHAYNEKFQG

SEQ ID NO: 313 - protein, 12 aa, artificial
  VH CDR3 of BCMA-32
DGYYRDTDVLDY

SEQ ID NO: 314 - protein, 11 aa, artificial
  VL CDR1 of BCMA-32
QASQDISNYLN

SEQ ID NO: 315 - protein, 7 aa, artificial
  VL CDR2 of BCMA-32
YTSRLHT

SEQ ID NO: 316 - protein, 9 aa, artificial
  VL CDR3 of BCMA-32
QQGNTLPWT

SEQ ID NO: 317 - protein, 121 aa, artificial
  VH of BCMA-32
QVQLVQSGAEVKKPGASVKVSCKASGYTFTNHIIHWVRQAPGQGLEWMGYINPYPGYHAYNEKFQGRATMTSDTSTSTVYMELSSLRSEDTAVYYCARDGYYRDTDVLDYWGQGTLVTVSS

SEQ ID NO: 318 - protein, 107 aa, artificial
  VL of BCMA-32
DIQMTQSPSSLSASLGDRVTITCQASQDISNYLNWYQQKPGKAPKLLIYYTSRLHTGVPSRFSGSGSGTDFTFTISSLQQEDIATYYCQQGNTLPWTFGQGTKVEIK

SEQ ID NO: 319 - protein, 243 aa, artificial
  BCMA-32 scFv
QVQLVQSGAEVKKPGASVKVSCKASGYTFTNHIIHWVRQAPGQGLEWMGYINPYPGYHAYNEKFQGRATMTSDTSTSTVYMELSSLRSEDTAVYYCARDGYYRDTDVLDYWGQGTLVTVSSGGGGSGGGGSGGGGSDIQMTQSPSSLSASLGDRVTITCQASQDISNYLNWYQQKPGKAPKLLIYYTSRLHTGVPSRFSGSGSGTDFTFTISSLQQEDIATYYCQQGNTLPWTFGQGTKVEIK

SEQ ID NO: 320 - protein, 498 aa, artificial
  BCMA-32 HL x CD3 HL bispecific molecule
QVQLVQSGAEVKKPGASVKVSCKASGYTFTNHIIHWVRQAPGQGLEWMGYINPYPGYHAYNEKFQGRATMTSDTSTSTVYMELSSLRSEDTAVYYCARDGYYRDTDVLDYWGQGTLVTVSSGGGGSGGGGSGGGGSDIQMTQSPSSLSASLGDRVTITCQASQDISNYLNWYQQKPGKAPKLLIYYTSRLHTGVPSRFSGSGSGTDFTFTISSLQQEDIATYYCQQGNTLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 321 - protein, 5 aa, artificial
  VH CDR1 of BCMA-33
NHIIH

SEQ ID NO: 322 - protein, 17 aa, artificial
  VH CDR2 of BCMA-33
YINPYDGWGDYNEKFQG

SEQ ID NO: 323 - protein, 12 aa, artificial
  VH CDR3 of BCMA-33
DGYYRDADVLDY

SEQ ID NO: 324 - protein, 11 aa, artificial
  VL CDR1 of BCMA-33
QASQDISNYLN

SEQ ID NO: 325 - protein, 7 aa, artificial
  VL CDR2 of BCMA-33
YTSRLHT

SEQ ID NO: 326 - protein, 9 aa, artificial
  VL CDR3 of BCMA-33
QQGNTLPWT

SEQ ID NO: 327 - protein, 121 aa, artificial
  VH of BCMA-33
QVQLVQSGAEVKKPGASVKVSCKASGYTFTNHIIHWVRQAPGQGLEWMGYINPYDGWGDYNEKFQGRATMTSDTSTSTVYMELSSLRSEDTAVYYCARDGYYRDADVLDYWGQGTLVTVSS

SEQ ID NO: 328 - protein, 107 aa, artificial; identical to SEQ ID NO: 318
  VL of BCMA-33

SEQ ID NO: 329 - protein, 243 aa, artificial
  BCMA-33 scFv
QVQLVQSGAEVKKPGASVKVSCKASGYTFTNHIIHWVRQAPGQGLEWMGYINPYDGWGDYNEKFQGRATMTSDTSTSTVYMELSSLRSEDTAVYYCARDGYYRDADVLDYWGQGTLVTVSSGGGGSGGGGSGGGGSDIQMTQSPSSLSASLGDRVTITCQASQDISNYLNWYQQKPGKAPKLLIYYTSRLHTGVPSRFSGSGSGTDFTFTISSLQQEDIATYYCQQGNTLPWTFGQGTKVEIK

SEQ ID NO: 330 - protein, 498 aa, artificial
  BCMA-33 HL x CD3 HL bispecific molecule
QVQLVQSGAEVKKPGASVKVSCKASGYTFTNHIIHWVRQAPGQGLEWMGYINPYDGWGDYNEKFQGRATMTSDTSTSTVYMELSSLRSEDTAVYYCARDGYYRDADVLDYWGQGTLVTVSSGGGGSGGGGSGGGGSDIQMTQSPSSLSASLGDRVTITCQASQDISNYLNWYQQKPGKAPKLLIYYTSRLHTGVPSRFSGSGSGTDFTFTISSLQQEDIATYYCQQGNTLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 331 - protein, 5 aa, artificial
  VH CDR1 of BCMA-34
NHIIH

SEQ ID NO: 332 - protein, 17 aa, artificial
  VH CDR2 of BCMA-34
YINPYPGYHAYNEKFQG

SEQ ID NO: 333 - protein, 12 aa, artificial
  VH CDR3 of BCMA-34
DGYYRDTDVLDY

SEQ ID NO: 334 - protein, 11 aa, artificial
  VL CDR1 of BCMA-34
QASQDISNYLN

SEQ ID NO: 335 - protein, 7 aa, artificial
  VL CDR2 of BCMA-34
YTSRLHT

SEQ ID NO: 336 - protein, 9 aa, artificial
  VL CDR3 of BCMA-34
QQGNTLPWT

SEQ ID NO: 337 - protein, 121 aa, artificial; identical to SEQ ID NO: 317
  VH of BCMA-34

SEQ ID NO: 338 - protein, 107 aa, artificial
  VL of BCMA-34
DIQMTQSPSSLSASVGDRVTITCQASQDISNYLNWYQQKPGKAPKLLIYYTSRLHTGVPSRFSGSGSGTDFTFTISSLEPEDIATYYCQQGNTLPWTFGQGTKVEIK

SEQ ID NO: 339 - protein, 243 aa, artificial
  BCMA-34 scFv
QVQLVQSGAEVKKPGASVKVSCKASGYTFTNHIIHWVRQAPGQGLEWMGYINPYPGYHAYNEKFQGRATMTSDTSTSTVYMELSSLRSEDTAVYYCARDGYYRDTDVLDYWGQGTLVTVSSGGGGSGGGGSGGGGSDIQMTQSPSSLSASVGDRVTITCQASQDISNYLNWYQQKPGKAPKLLIYYTSRLHTGVPSRFSGSGSGTDFTFTISSLEPEDIATYYCQQGNTLPWTFGQGTKVEIK

SEQ ID NO: 340 - protein, 498 aa, artificial
  BCMA-34 HL x CD3 HL bispecific molecule
QVQLVQSGAEVKKPGASVKVSCKASGYTFTNHIIHWVRQAPGQGLEWMGYINPYPGYHAYNEKFQGRATMTSDTSTSTVYMELSSLRSEDTAVYYCARDGYYRDTDVLDYWGQGTLVTVSSGGGGSGGGGSGGGGSDIQMTQSPSSLSASVGDRVTITCQASQDISNYLNWYQQKPGKAPKLLIYYTSRLHTGVPSRFSGSGSGTDFTFTISSLEPEDIATYYCQQGNTLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 341 - protein, 5 aa, artificial
  VH CDR1 of BCMA-35
NHIIH

SEQ ID NO: 342 - protein, 17 aa, artificial
  VH CDR2 of BCMA-35
YINPYDGWGDYNEKFQG

SEQ ID NO: 343 - protein, 12 aa, artificial
  VH CDR3 of BCMA-35
DGYYRDADVLDY

SEQ ID NO: 344 - protein, 11 aa, artificial
  VL CDR1 of BCMA-35
QASQDISNYLN

SEQ ID NO: 345 - protein, 7 aa, artificial
  VL CDR2 of BCMA-35
YTSRLHT

SEQ ID NO: 346 - protein, 9 aa, artificial
  VL CDR3 of BCMA-35
QQGNTLPWT

SEQ ID NO: 347 - protein, 121 aa, artificial; identical to SEQ ID NO: 327
  VH of BCMA-35

SEQ ID NO: 348 - protein, 107 aa, artificial; identical to SEQ ID NO: 338
  VL of BCMA-35

SEQ ID NO: 349 - protein, 243 aa, artificial
  BCMA-35 scFv
QVQLVQSGAEVKKPGASVKVSCKASGYTFTNHIIHWVRQAPGQGLEWMGYINPYDGWGDYNEKFQGRATMTSDTSTSTVYMELSSLRSEDTAVYYCARDGYYRDADVLDYWGQGTLVTVSSGGGGSGGGGSGGGGSDIQMTQSPSSLSASVGDRVTITCQASQDISNYLNWYQQKPGKAPKLLIYYTSRLHTGVPSRFSGSGSGTDFTFTISSLEPEDIATYYCQQGNTLPWTFGQGTKVEIK

SEQ ID NO: 350 - protein, 498 aa, artificial
  BCMA-35 HL x CD3 HL bispecific molecule
QVQLVQSGAEVKKPGASVKVSCKASGYTFTNHIIHWVRQAPGQGLEWMGYINPYDGWGDYNEKFQGRATMTSDTSTSTVYMELSSLRSEDTAVYYCARDGYYRDADVLDYWGQGTLVTVSSGGGGSGGGGSGGGGSDIQMTQSPSSLSASVGDRVTITCQASQDISNYLNWYQQKPGKAPKLLIYYTSRLHTGVPSRFSGSGSGTDFTFTISSLEPEDIATYYCQQGNTLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 351 - protein, 5 aa, artificial
  VH CDR1 of BCMA-36
NHIIH

SEQ ID NO: 352 - protein, 17 aa, artificial
  VH CDR2 of BCMA-36
YINPYPGYHAYNQKFQG

SEQ ID NO: 353 - protein, 12 aa, artificial
  VH CDR3 of BCMA-36
DGYYRDTDVLDY

SEQ ID NO: 354 - protein, 11 aa, artificial
  VL CDR1 of BCMA-36
QASQDISNYLN

SEQ ID NO: 355 - protein, 7 aa, artificial
  VL CDR2 of BCMA-36
YTSRLHT

SEQ ID NO: 356 - protein, 9 aa, artificial
  VL CDR3 of BCMA-36
QQGNTLPWT

SEQ ID NO: 357 - protein, 121 aa, artificial
  VH of BCMA-36
QVQLVQSGAKVIKPGASVKVSCKASGYTFTNHIIHWVRQKPGQGLEWMGYINPYPGYHAYNQKFQGRVTMTRDKSTSTVYMELSSLTSEDTAVYYCARDGYYRDTDVLDYWGQGTLVTVSS

SEQ ID NO: 358 - protein, 107 aa, artificial
  VL of BCMA-36
DIQMTQSPSSLSASVGDRVTITCQASQDISNYLNWYQQKPGRAPKLLIYYTSRLHTGVPSRFSGSGSGTDYSFTISSLQPEDIATYYCQQGNTLPWTFGQGTKVEIK

SEQ ID NO: 359 - protein, 243 aa, artificial
  BCMA-36 scFv
QVQLVQSGAKVIKPGASVKVSCKASGYTFTNHIIHWVRQKPGQGLEWMGYINPYPGYHAYNQKFQGRVTMTRDKSTSTVYMELSSLTSEDTAVYYCARDGYYRDTDVLDYWGQGTLVTVSSGGGGSGGGGSGGGGSDIQMTQSPSSLSASVGDRVTITCQASQDISNYLNWYQQKPGRAPKLLIYYTSRLHTGVPSRFSGSGSGTDYSFTISSLQPEDIATYYCQQGNTLPWTFGQGTKVEIK

SEQ ID NO: 360 - protein, 498 aa, artificial
  BCMA-36 HL x CD3 HL bispecific molecule
QVQLVQSGAKVIKPGASVKVSCKASGYTFTNHIIHWVRQKPGQGLEWMGYINPYPGYHAYNQKFQGRVTMTRDKSTSTVYMELSSLTSEDTAVYYCARDGYYRDTDVLDYWGQGTLVTVSSGGGGSGGGGSGGGGSDIQMTQSPSSLSASVGDRVTITCQASQDISNYLNWYQQKPGRAPKLLIYYTSRLHTGVPSRFSGSGSGTDYSFTISSLQPEDIATYYCQQGNTLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 361 - protein, 5 aa, artificial
  VH CDR1 of BCMA-37
NHIIH

SEQ ID NO: 362 - protein, 17 aa, artificial
  VH CDR2 of BCMA-37
YINPYDGWGDYNQKFQG

SEQ ID NO: 363 - protein, 12 aa, artificial
  VH CDR3 of BCMA-37
DGYYRDADVLDY

SEQ ID NO: 364 - protein, 11 aa, artificial
  VL CDR1 of BCMA-37
QASQDISNYLN

SEQ ID NO: 365 - protein, 7 aa, artificial
  VL CDR2 of BCMA-37
YTSRLHT

SEQ ID NO: 366 - protein, 9 aa, artificial
  VL CDR3 of BCMA-37
QQGNTLPWT

SEQ ID NO: 367 - protein, 121 aa, artificial
  VH of BCMA-37
QVQLVQSGAKVIKPGASVKVSCKASGYTFTNHIIHWVRQKPGQGLEWMGYINPYDGWGDYNQKFQGRVTMTRDKSTSTVYMELSSLTSEDTAVYYCARDGYYRDADVLDYWGQGTLVTVSS

SEQ ID NO: 368 - protein, 107 aa, artificial; identical to SEQ ID NO: 358
  VL of BCMA-37

SEQ ID NO: 369 - protein, 243 aa, artificial
  BCMA-37 scFv
QVQLVQSGAKVIKPGASVKVSCKASGYTFTNHIIHWVRQKPGQGLEWMGYINPYDGWGDYNQKFQGRVTMTRDKSTSTVYMELSSLTSEDTAVYYCARDGYYRDADVLDYWGQGTLVTVSSGGGGSGGGGSGGGGSDIQMTQSPSSLSASVGDRVTITCQASQDISNYLNWYQQKPGRAPKLLIYYTSRLHTGVPSRFSGSGSGTDYSFTISSLQPEDIATYYCQQGNTLPWTFGQGTKVEIK

SEQ ID NO: 370 - protein, 498 aa, artificial
  BCMA-37 HL x CD3 HL bispecific molecule
QVQLVQSGAKVIKPGASVKVSCKASGYTFTNHIIHWVRQKPGQGLEWMGYINPYDGWGDYNQKFQGRVTMTRDKSTSTVYMELSSLTSEDTAVYYCARDGYYRDADVLDYWGQGTLVTVSSGGGGSGGGGSGGGGSDIQMTQSPSSLSASVGDRVTITCQASQDISNYLNWYQQKPGRAPKLLIYYTSRLHTGVPSRFSGSGSGTDYSFTISSLQPEDIATYYCQQGNTLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 371 - protein, 5 aa, artificial
  VH CDR1 of BCMA-38
NHIIH

SEQ ID NO: 372 - protein, 17 aa, artificial
  VH CDR2 of BCMA-38
YINPYPGYHAYNQKFQG

SEQ ID NO: 373 - protein, 12 aa, artificial
  VH CDR3 of BCMA-38
DGYYRDTDVLDY

SEQ ID NO: 374 - protein, 11 aa, artificial
  VL CDR1 of BCMA-38
QASQDISNYLN

SEQ ID NO: 375 - protein, 7 aa, artificial
  VL CDR2 of BCMA-38
YTSRLHT

SEQ ID NO: 376 - protein, 9 aa, artificial
  VL CDR3 of BCMA-38
QQGNTLPWT

SEQ ID NO: 377 - protein, 121 aa, artificial
  VH of BCMA-38
QVQLVQSGAEVIKPGASVKVSCKASGYTFTNHIIHWVRQKPGQGLEWIGYINPYPGYHAYNQKFQGKVTMTRDTSTSTVYMELSSLTSEDTAVYYCARDGYYRDTDVLDYWGQGTLVTVSS

SEQ ID NO: 378 - protein, 107 aa, artificial; identical to SEQ ID NO: 318
  VL of BCMA-38

SEQ ID NO: 379 - protein, 243 aa, artificial
  BCMA-38 scFv
QVQLVQSGAEVIKPGASVKVSCKASGYTFTNHIIHWVRQKPGQGLEWIGYINPYPGYHAYNQKFQGKVTMTRDTSTSTVYMELSSLTSEDTAVYYCARDGYYRDTDVLDYWGQGTLVTVSSGGGGSGGGGSGGGGSDIQMTQSPSSLSASLGDRVTITCQASQDISNYLNWYQQKPGKAPKLLIYYTSRLHTGVPSRFSGSGSGTDFTFTISSLQQEDIATYYCQQGNTLPWTFGQGTKVEIK

SEQ ID NO: 380 - protein, 498 aa, artificial
  BCMA-38 HL x CD3 HL bispecific molecule
QVQLVQSGAEVIKPGASVKVSCKASGYTFTNHIIHWVRQKPGQGLEWIGYINPYPGYHAYNQKFQGKVTMTRDTSTSTVYMELSSLTSEDTAVYYCARDGYYRDTDVLDYWGQGTLVTVSSGGGGSGGGGSGGGGSDIQMTQSPSSLSASLGDRVTITCQASQDISNYLNWYQQKPGKAPKLLIYYTSRLHTGVPSRFSGSGSGTDFTFTISSLQQEDIATYYCQQGNTLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 381 - protein, 5 aa, artificial
  VH CDR1 of BCMA-39
NHIIH

SEQ ID NO: 382 - protein, 17 aa, artificial
  VH CDR2 of BCMA-39
YINPYDGWGDYNQKFQG

SEQ ID NO: 383 - protein, 12 aa, artificial
  VH CDR3 of BCMA-39
DGYYRDADVLDY

SEQ ID NO: 384 - protein, 11 aa, artificial
  VL CDR1 of BCMA-39
QASQDISNYLN

SEQ ID NO: 385 - protein, 7 aa, artificial
  VL CDR2 of BCMA-39
YTSRLHT

SEQ ID NO: 386 - protein, 9 aa, artificial
  VL CDR3 of BCMA-39
QQGNTLPWT

SEQ ID NO: 387 - protein, 121 aa, artificial
  VH of BCMA-39
QVQLVQSGAEVIKPGASVKVSCKASGYTFTNHIIHWVRQKPGQGLEWIGYINPYDGWGDYNQKFQGKVTMTRDTSTSTVYMELSSLTSEDTAVYYCARDGYYRDADVLDYWGQGTLVTVSS

SEQ ID NO: 388 - protein, 107 aa, artificial; identical to SEQ ID NO: 318
  VL of BCMA-39

SEQ ID NO: 389 - protein, 243 aa, artificial
  BCMA-39 scFv
QVQLVQSGAEVIKPGASVKVSCKASGYTFTNHIIHWVRQKPGQGLEWIGYINPYDGWGDYNQKFQGKVTMTRDTSTSTVYMELSSLTSEDTAVYYCARDGYYRDADVLDYWGQGTLVTVSSGGGGSGGGGSGGGGSDIQMTQSPSSLSASLGDRVTITCQASQDISNYLNWYQQKPGKAPKLLIYYTSRLHTGVPSRFSGSGSGTDFTFTISSLQQEDIATYYCQQGNTLPWTFGQGTKVEIK

SEQ ID NO: 390 - protein, 498 aa, artificial
  BCMA-39 HL x CD3 HL bispecific molecule
QVQLVQSGAEVIKPGASVKVSCKASGYTFTNHIIHWVRQKPGQGLEWIGYINPYDGWGDYNQKFQGKVTMTRDTSTSTVYMELSSLTSEDTAVYYCARDGYYRDADVLDYWGQGTLVTVSSGGGGSGGGGSGGGGSDIQMTQSPSSLSASLGDRVTITCQASQDISNYLNWYQQKPGKAPKLLIYYTSRLHTGVPSRFSGSGSGTDFTFTISSLQQEDIATYYCQQGNTLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 391 - protein, 5 aa, artificial
  VH CDR1 of BCMA-40
DYYIN

SEQ ID NO: 392 - protein, 17 aa, artificial
  VH CDR2 of BCMA-40
WIYFASGNSEYNQKFTG

SEQ ID NO: 393 - protein, 10 aa, artificial
  VH CDR3 of BCMA-40
LYDYDWYFDV

SEQ ID NO: 394 - protein, 16 aa, artificial
  VL CDR1 of BCMA-40
KSSQSLVHSNGNTYLH

SEQ ID NO: 395 - protein, 7 aa, artificial
  VL CDR2 of BCMA-40
KVSNRFS

SEQ ID NO: 396 - protein, 9 aa, artificial
  VL CDR3 of BCMA-40
SQSSTAPWT

SEQ ID NO: 397 - protein, 119 aa, artificial
  VH of BCMA-40
QVQLVQSGAEVKKPGASVKVSCKASGYSFPDYYINWVRQAPGQGLEWMGWIYFASGNSEYNQKFTGRVTMTRDTSISTAYMELSSLRSEDTAVYFCASLYDYDWYFDVWGQGTMVTVSS

SEQ ID NO: 398 - protein, 112 aa, artificial
  VL of BCMA-40
DIVMTQTPLSLPVTLGQPASISCKSSQSLVHSNGNTYLHWYLQKPGQSPQLLIYKVSNRFSGVPDRFSGSGSGTDFTLKISRVEAEDVGVYYCSQSSTAPWTFGQGTKLEIK

SEQ ID NO: 399 - protein, 246 aa, artificial
  BCMA-40 scFv
QVQLVQSGAEVKKPGASVKVSCKASGYSFPDYYINWVRQAPGQGLEWMGWIYFASGNSEYNQKFTGRVTMTRDTSISTAYMELSSLRSEDTAVYFCASLYDYDWYFDVWGQGTMVTVSSGGGGSGGGGSGGGGSDIVMTQTPLSLPVTLGQPASISCKSSQSLVHSNGNTYLHWYLQKPGQSPQLLIYKVSNRFSGVPDRFSGSGSGTDFTLKISRVEAEDVGVYYCSQSSTAPWTFGQGTKLEIK

SEQ ID NO: 400 - protein, 501 aa, artificial
  BCMA-40 HL x CD3 HL bispecific molecule
QVQLVQSGAEVKKPGASVKVSCKASGYSFPDYYINWVRQAPGQGLEWMGWIYFASGNSEYNQKFTGRVTMTRDTSISTAYMELSSLRSEDTAVYFCASLYDYDWYFDVWGQGTMVTVSSGGGGSGGGGSGGGGSDIVMTQTPLSLPVTLGQPASISCKSSQSLVHSNGNTYLHWYLQKPGQSPQLLIYKVSNRFSGVPDRFSGSGSGTDFTLKISRVEAEDVGVYYCSQSSTAPWTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 401 - protein, 5 aa, artificial
  VH CDR1 of BCMA-41
DYYIN

SEQ ID NO: 402 - protein, 17 aa, artificial
  VH CDR2 of BCMA-41
WIYFASGNSEYNQKFTG

SEQ ID NO: 403 - protein, 10 aa, artificial
  VH CDR3 of BCMA-41
LYDYDWYFDV

SEQ ID NO: 404 - protein, 16 aa, artificial
  VL CDR1 of BCMA-41
KSSQSLVHSNGNTYLH

SEQ ID NO: 405 - protein, 7 aa, artificial
  VL CDR2 of BCMA-41
KVSNRFS

SEQ ID NO: 406 - protein, 9 aa, artificial
  VL CDR3 of BCMA-41
SQSSIYPWT

SEQ ID NO: 407 - protein, 119 aa, artificial; identical to SEQ ID NO: 397
  VH of BCMA-41

SEQ ID NO: 408 - protein, 112 aa, artificial
  VL of BCMA-41
DIVMTQTPLSLPVTLGQPASISCKSSQSLVHSNGNTYLHWYLQKPGQSPQLLIYKVSNRFSGVPDRFSGSGSGTDFTLKISRVEAEDVGVYYCSQSSIYPWTFGQGTKLEIK

SEQ ID NO: 409 - protein, 246 aa, artificial
  BCMA-41 scFv
QVQLVQSGAEVKKPGASVKVSCKASGYSFPDYYINWVRQAPGQGLEWMGWIYFASGNSEYNQKFTGRVTMTRDTSISTAYMELSSLRSEDTAVYFCASLYDYDWYFDVWGQGTMVTVSSGGGGSGGGGSGGGGSDIVMTQTPLSLPVTLGQPASISCKSSQSLVHSNGNTYLHWYLQKPGQSPQLLIYKVSNRFSGVPDRFSGSGSGTDFTLKISRVEAEDVGVYYCSQSSIYPWTFGQGTKLEIK

SEQ ID NO: 410 - protein, 501 aa, artificial
  BCMA-41 HL x CD3 HL bispecific molecule
QVQLVQSGAEVKKPGASVKVSCKASGYSFPDYYINWVRQAPGQGLEWMGWIYFASGNSEYNQKFTGRVTMTRDTSISTAYMELSSLRSEDTAVYFCASLYDYDWYFDVWGQGTMVTVSSGGGGSGGGGSGGGGSDIVMTQTPLSLPVTLGQPASISCKSSQSLVHSNGNTYLHWYLQKPGQSPQLLIYKVSNRFSGVPDRFSGSGSGTDFTLKISRVEAEDVGVYYCSQSSIYPWTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 411 - protein, 5 aa, artificial
  VH CDR1 of BCMA-42
DYYIN

SEQ ID NO: 412 - protein, 17 aa, artificial
  VH CDR2 of BCMA-42
WIYFASGNSEYNQKFTG

SEQ ID NO: 413 - protein, 10 aa, artificial
  VH CDR3 of BCMA-42
LYDYDWYFDV

SEQ ID NO: 414 - protein, 16 aa, artificial
  VL CDR1 of BCMA-42
KSSQSLVHSNGNTYLH

SEQ ID NO: 415 - protein, 7 aa, artificial
  VL CDR2 of BCMA-42
KVSNRFS

SEQ ID NO: 416 - protein, 9 aa, artificial
  VL CDR3 of BCMA-42
SQSTYPEFT

SEQ ID NO: 417 - protein, 119 aa, artificial; identical to SEQ ID NO: 397
  VH of BCMA-42

SEQ ID NO: 418 - protein, 112 aa, artificial
  VL of BCMA-42
DIVMTQTPLSLPVTLGQPASISCKSSQSLVHSNGNTYLHWYLQKPGQSPQLLIYKVSNRFSGVPDRFSGSGSGTDFTLKISRVEAEDVGVYYCSQSTYPEFTFGQGTKLEIK

SEQ ID NO: 419 - protein, 246 aa, artificial
  BCMA-42 scFv
QVQLVQSGAEVKKPGASVKVSCKASGYSFPDYYINWVRQAPGQGLEWMGWIYFASGNSEYNQKFTGRVTMTRDTSISTAYMELSSLRSEDTAVYFCASLYDYDWYFDVWGQGTMVTVSSGGGGSGGGGSGGGGSDIVMTQTPLSLPVTLGQPASISCKSSQSLVHSNGNTYLHWYLQKPGQSPQLLIYKVSNRFSGVPDRFSGSGSGTDFTLKISRVEAEDVGVYYCSQSTYPEFTFGQGTKLEIK

SEQ ID NO: 420 - protein, 501 aa, artificial
  BCMA-42 HL x CD3 HL bispecific molecule
QVQLVQSGAEVKKPGASVKVSCKASGYSFPDYYINWVRQAPGQGLEWMGWIYFASGNSEYNQKFTGRVTMTRDTSISTAYMELSSLRSEDTAVYFCASLYDYDWYFDVWGQGTMVTVSSGGGGSGGGGSGGGGSDIVMTQTPLSLPVTLGQPASISCKSSQSLVHSNGNTYLHWYLQKPGQSPQLLIYKVSNRFSGVPDRFSGSGSGTDFTLKISRVEAEDVGVYYCSQSTYPEFTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 421 - protein, 5 aa, artificial
  VH CDR1 of BCMA-43
DYYIN

SEQ ID NO: 422 - protein, 17 aa, artificial
  VH CDR2 of BCMA-43
WIYFASGNSEYNQKFTG

SEQ ID NO: 423 - protein, 10 aa, artificial
  VH CDR3 of BCMA-43
LYDYDWYFDV

SEQ ID NO: 424 - protein, 16 aa, artificial
  VL CDR1 of BCMA-43
KSSQSLVHSNGNTYLH

SEQ ID NO: 425 - protein, 7 aa, artificial
  VL CDR2 of BCMA-43
KVSNRFS

SEQ ID NO: 426 - protein, 9 aa, artificial
  VL CDR3 of BCMA-43
SQSSTAPWT

SEQ ID NO: 427 - protein, 119 aa, artificial; identical to SEQ ID NO: 397
  VH of BCMA-43

SEQ ID NO: 428 - protein, 112 aa, artificial
  VL of BCMA-43
DIVMTQTPLSLSVTPGQPASISCKSSQSLVHSNGNTYLHWYLQKPGQSPQLLIYKVSNRFSGVPDRFSGSGSGTDFTLKISRVEAEDVGVYYCSQSSTAPWTFGQGTKLEIK

SEQ ID NO: 429 - protein, 246 aa, artificial
  BCMA-43 scFv
QVQLVQSGAEVKKPGASVKVSCKASGYSFPDYYINWVRQAPGQGLEWMGWIYFASGNSEYNQKFTGRVTMTRDTSISTAYMELSSLRSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGVYYCSQSSTAPWTFGQGTKLEIK

SEQ ID NO: 430 - protein, 501 aa, artificial
  BCMA-43 HL x CD3 HL bispecific molecule
QVQLVQSGAEVKKPGASVKVSCKASGYSFPDYYINWVRQAPGQGLEWMGWIYFASGNSEYNQKFTGRVTMTRDTSISTAYMELSSLRSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGVYYCSQSSTAPWTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 431 - protein, 5 aa, artificial
  VH CDR1 of BCMA-44
DYYIN

SEQ ID NO: 432 - protein, 17 aa, artificial
  VH CDR2 of BCMA-44
WIYFASGNSEYNQKFTG

SEQ ID NO: 433 - protein, 10 aa, artificial
  VH CDR3 of BCMA-44
LYDYDWYFDV

SEQ ID NO: 434 - protein, 16 aa, artificial
  VL CDR1 of BCMA-44
KSSQSLVHSNGNTYLH

SEQ ID NO: 435 - protein, 7 aa, artificial
  VL CDR2 of BCMA-44
KVSNRFS

SEQ ID NO: 436 - protein, 9 aa, artificial
  VL CDR3 of BCMA-44
SQSSIYPWT

SEQ ID NO: 437 - protein, 119 aa, artificial; identical to SEQ ID NO: 397
  VH of BCMA-44

SEQ ID NO: 438 - protein, 112 aa, artificial
  VL of BCMA-44
DIVMTQTPLSLSVTPGQPASISCKSSQSLVHSNGNTYLHWYLQKPGQSPQLLIYKVSNRFSGVPDRFSGSGSGTDFTLKISRVEAEDVGVYYCSQSSIYPWTFGQGTKLEIK

SEQ ID NO: 439 - protein, 246 aa, artificial
  BCMA-44 scFv
QVQLVQSGAEVKKPGASVKVSCKASGYSFPDYYINWVRQAPGQGLEWMGWIYFASGNSEYNQKFTGRVTMTRDTSISTAYMELSSLRSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGVYYCSQSSIYPWTFGQGTKLEIK

SEQ ID NO: 440 - protein, 501 aa, artificial
  BCMA-44 HL x CD3 HL bispecific molecule
QVQLVQSGAEVKKPGASVKVSCKASGYSFPDYYINWVRQAPGQGLEWMGWIYFASGNSEYNQKFTGRVTMTRDTSISTAYMELSSLRSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGVYYCSQSSIYPWTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 441 - protein, 5 aa, artificial
  VH CDR1 of BCMA-45
DYYIN

SEQ ID NO: 442 - protein, 17 aa, artificial
  VH CDR2 of BCMA-45
WIYFASGNSEYNQKFTG

SEQ ID NO: 443 - protein, 10 aa, artificial
  VH CDR3 of BCMA-45
LYDYDWYFDV

SEQ ID NO: 444 - protein, 16 aa, artificial
  VL CDR1 of BCMA-45
KSSQSLVHSNGNTYLH

SEQ ID NO: 445 - protein, 7 aa, artificial
  VL CDR2 of BCMA-45
KVSNRFS

SEQ ID NO: 446 - protein, 9 aa, artificial
  VL CDR3 of BCMA-45
SQSTYPEFT

SEQ ID NO: 447 - protein, 119 aa, artificial; identical to SEQ ID NO: 397
  VH of BCMA-45

SEQ ID NO: 448 - protein, 112 aa, artificial
  VL of BCMA-45
DIVMTQTPLSLSVTPGQPASISCKSSQSLVHSNGNTYLHWYLQKPGQSPQLLIYKVSNRFSGVPDRFSGSGSGTDFTLKISRVEAEDVGVYYCSQSTYPEFTFGQGTKLEIK

SEQ ID NO: 449 - protein, 246 aa, artificial
  BCMA-45 scFv
QVQLVQSGAEVKKPGASVKVSCKASGYSFPDYYINWVRQAPGQGLEWMGWIYFASGNSEYNQKFTGRVTMTRDTSISTAYMELSSLRSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGVYYCSQSTYPEFTFGQGTKLEIK

SEQ ID NO: 450 - protein, 501 aa, artificial
  BCMA-45 HL x CD3 HL bispecific molecule
QVQLVQSGAEVKKPGASVKVSCKASGYSFPDYYINWVRQAPGQGLEWMGWIYFASGNSEYNQKFTGRVTMTRDTSISTAYMELSSLRSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGVYYCSQSTYPEFTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 451 - protein, 5 aa, artificial
  VH CDR1 of BCMA-46
DYYIN

SEQ ID NO: 452 - protein, 17 aa, artificial
  VH CDR2 of BCMA-46
WIYFASGNSEYNEKFTG

SEQ ID NO: 453 - protein, 10 aa, artificial
  VH CDR3 of BCMA-46
LYDYDWYFDV

SEQ ID NO: 454 - protein, 16 aa, artificial
  VL CDR1 of BCMA-46
KSSQSLVHSNGNTYLH

SEQ ID NO: 455 - protein, 7 aa, artificial
  VL CDR2 of BCMA-46
KVSNRFS

SEQ ID NO: 456 - protein, 9 aa, artificial
  VL CDR3 of BCMA-46
SQSSTAPWT

SEQ ID NO: 457 - protein, 119 aa, artificial
  VH of BCMA-46
QVQLVQSGAEVKKPGASVKVSCKASGYSFPDYYINWVRQAPGQGLEWMGWIYFASGNSEYNEKFTGRVTMTRDTSSSTAYMELSSLRSEDTAVYFCASLYDYDWYFDVWGQGTMVTVSS

SEQ ID NO: 458 - protein, 112 aa, artificial
  VL of BCMA-46
DIVMTQTPLSLSVSLGQPASISCKSSQSLVHSNGNTYLHWYLQKPGQSPQLLIYKVSNRFSGVPDRFSGSGSGTDFTLKISRVEAEDVGVYYCSQSSTAPWTFGQGTKLEIK

SEQ ID NO: 459 - protein, 246 aa, artificial
  BCMA-46 scFv
QVQLVQSGAEVKKPGASVKVSCKASGYSFPDYYINWVRQAPGQGLEWMGWIYFASGNSEYNEKFTGRVTMTRDTSSSTAYMELSSLRSEDTAVYFCASLYDYDWYFDVWGQGTMVTVSSGGGGSGGGGSGGGGSDIVMTQTPLSLSVSLGQPASISCKSSQSLVHSNGNTYLHWYLQKPGQSPQLLIYKVSNRFSGVPDRFSGSGSGTDFTLKISRVEAEDVGVYYCSQSSTAPWTFGQGTKLEIK

SEQ ID NO: 460 - protein, 501 aa, artificial
  BCMA-46 HL x CD3 HL bispecific molecule
QVQLVQSGAEVKKPGASVKVSCKASGYSFPDYYINWVRQAPGQGLEWMGWIYFASGNSEYNEKFTGRVTMTRDTSSSTAYMELSSLRSEDTAVYFCASLYDYDWYFDVWGQGTMVTVSSGGGGSGGGGSGGGGSDIVMTQTPLSLSVSLGQPASISCKSSQSLVHSNGNTYLHWYLQKPGQSPQLLIYKVSNRFSGVPDRFSGSGSGTDFTLKISRVEAEDVGVYYCSQSSTAPWTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 461 - protein, 5 aa, artificial
  VH CDR1 of BCMA-47
DYYIN

SEQ ID NO: 462 - protein, 17 aa, artificial
  VH CDR2 of BCMA-47
WIYFASGNSEYNEKFTG

SEQ ID NO: 463 - protein, 10 aa, artificial
  VH CDR3 of BCMA-47
LYDYDWYFDV

SEQ ID NO: 464 - protein, 16 aa, artificial
  VL CDR1 of BCMA-47
KSSQSLVHSNGNTYLH

SEQ ID NO: 465 - protein, 7 aa, artificial
  VL CDR2 of BCMA-47
KVSNRFS

SEQ ID NO: 466 - protein, 9 aa, artificial
  VL CDR3 of BCMA-47
SQSSIYPWT

SEQ ID NO: 467 - protein, 119 aa, artificial; identical to SEQ ID NO: 457
  VH of BCMA-47

SEQ ID NO: 468 - protein, 112 aa, artificial
  VL of BCMA-47
DIVMTQTPLSLSVSLGQPASISCKSSQSLVHSNGNTYLHWYLQKPGQSPQLLIYKVSNRFSGVPDRFSGSGSGTDFTLKISRVEAEDVGVYYCSQSSIYPWTFGQGTKLEIK

SEQ ID NO: 469 - protein, 246 aa, artificial
  BCMA-47 scFv
QVQLVQSGAEVKKPGASVKVSCKASGYSFPDYYINWVRQAPGQGLEWMGWIYFASGNSEYNEKFTGRVTMTRDTSSSTAYMELSSLRSEDTAVYFCASLYDYDWYFDVWGQGTMVTVSSGGGGSGGGGSGGGGSDIVMTQTPLSLSVSLGQPASISCKSSQSLVHSNGNTYLHWYLQKPGQSPQLLIYKVSNRFSGVPDRFSGSGSGTDFTLKISRVEAEDVGVYYCSQSSIYPWTFGQGTKLEIK

SEQ ID NO: 470 - protein, 501 aa, artificial
  BCMA-47 HL x CD3 HL bispecific molecule
QVQLVQSGAEVKKPGASVKVSCKASGYSFPDYYINWVRQAPGQGLEWMGWIYFASGNSEYNEKFTGRVTMTRDTSSSTAYMELSSLRSEDTAVYFCASLYDYDWYFDVWGQGTMVTVSSGGGGSGGGGSGGGGSDIVMTQTPLSLSVSLGQPASISCKSSQSLVHSNGNTYLHWYLQKPGQSPQLLIYKVSNRFSGVPDRFSGSGSGTDFTLKISRVEAEDVGVYYCSQSSIYPWTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 471 - protein, 5 aa, artificial
  VH CDR1 of BCMA-48
DYYIN

SEQ ID NO: 472 - protein, 17 aa, artificial
  VH CDR2 of BCMA-48
WIYFASGNSEYNEKFTG

SEQ ID NO: 473 - protein, 10 aa, artificial
  VH CDR3 of BCMA-48
LYDYDWYFDV

SEQ ID NO: 474 - protein, 16 aa, artificial
  VL CDR1 of BCMA-48
KSSQSLVHSNGNTYLH

SEQ ID NO: 475 - protein, 7 aa, artificial
  VL CDR2 of BCMA-48
KVSNRFS

SEQ ID NO: 476 - protein, 9 aa, artificial
  VL CDR3 of BCMA-48
SQSTYPEFT

SEQ ID NO: 477 - protein, 119 aa, artificial; identical to SEQ ID NO: 457
  VH of BCMA-48

SEQ ID NO: 478 - protein, 112 aa, artificial
  VL of BCMA-48
DIVMTQTPLSLSVSLGQPASISCKSSQSLVHSNGNTYLHWYLQKPGQSPQLLIYKVSNRFSGVPDRFSGSGSGTDFTLKISRVEAEDVGVYYCSQSTYPEFTFGQGTKLEIK

SEQ ID NO: 479 - protein, 246 aa, artificial
  BCMA-48 scFv
QVQLVQSGAEVKKPGASVKVSCKASGYSFPDYYINWVRQAPGQGLEWMGWIYFASGNSEYNEKFTGRVTMTRDTSSSTAYMELSSLRSEDTAVYFCASLYDYDWYFDVWGQGTMVTVSSGGGGSGGGGSGGGGSDIVMTQTPLSLSVSLGQPASISCKSSQSLVHSNGNTYLHWYLQKPGQSPQLLIYKVSNRFSGVPDRFSGSGSGTDFTLKISRVEAEDVGVYYCSQSTYPEFTFGQGTKLEIK

SEQ ID NO: 480 - protein, 501 aa, artificial
  BCMA-48 HL x CD3 HL bispecific molecule
QVQLVQSGAEVKKPGASVKVSCKASGYSFPDYYINWVRQAPGQGLEWMGWIYFASGNSEYNEKFTGRVTMTRDTSSSTAYMELSSLRSEDTAVYFCASLYDYDWYFDVWGQGTMVTVSSGGGGSGGGGSGGGGSDIVMTQTPLSLSVSLGQPASISCKSSQSLVHSNGNTYLHWYLQKPGQSPQLLIYKVSNRFSGVPDRFSGSGSGTDFTLKISRVEAEDVGVYYCSQSTYPEFTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 481 - protein, 5 aa, artificial
  VH CDR1 of BCMA-49
DYYIN

SEQ ID NO: 482 - protein, 17 aa, artificial
  VH CDR2 of BCMA-49
WIYFASGNSEYNQKFTG

SEQ ID NO: 483 - protein, 10 aa, artificial
  VH CDR3 of BCMA-49
LYDYDWYFDV

SEQ ID NO: 484 - protein, 16 aa, artificial
  VL CDR1 of BCMA-49
KSSQSLVHSNGNTYLH

SEQ ID NO: 485 - protein, 7 aa, artificial
  VL CDR2 of BCMA-49
KVSNRFS

SEQ ID NO: 486 - protein, 9 aa, artificial
  VL CDR3 of BCMA-49
SQSSTAPWT

SEQ ID NO: 487 - protein, 119 aa, artificial
  VH of BCMA-49
QVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSS

SEQ ID NO: 488 - protein, 112 aa, artificial
  VL of BCMA-49
DIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSTAPWTFGQGTKLEIK

SEQ ID NO: 489 - protein, 246 aa, artificial
  BCMA-49 scFv
QVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSTAPWTFGQGTKLEIK

SEQ ID NO: 490 - protein, 501 aa, artificial
  BCMA-49 HL x CD3 HL bispecific molecule
QVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSTAPWTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 491 - protein, 5 aa, artificial
  VH CDR1 of BCMA-50
DYYIN

SEQ ID NO: 492 - protein, 17 aa, artificial
  VH CDR2 of BCMA-50
WIYFASGNSEYNQKFTG

SEQ ID NO: 493 - protein, 10 aa, artificial
  VH CDR3 of BCMA-50
LYDYDWYFDV

SEQ ID NO: 494 - protein, 16 aa, artificial
  VL CDR1 of BCMA-50
KSSQSLVHSNGNTYLH

SEQ ID NO: 495 - protein, 7 aa, artificial
  VL CDR2 of BCMA-50
KVSNRFS

SEQ ID NO: 496 - protein, 9 aa, artificial
  VL CDR3 of BCMA-50
SQSSIYPWT

SEQ ID NO: 497 - protein, 119 aa, artificial; identical to SEQ ID NO: 487
  VH of BCMA-50

SEQ ID NO: 498 - protein, 112 aa, artificial
  VL of BCMA-50
DIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIK

SEQ ID NO: 499 - protein, 246 aa, artificial
  BCMA-50 scFv
QVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIK

SEQ ID NO: 500 - protein, 501 aa, artificial
  BCMA-50 HL x CD3 HL bispecific molecule
QVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 501 - protein, 5 aa, artificial
  VH CDR1 of BCMA-51
DYYIN

SEQ ID NO: 502 - protein, 17 aa, artificial
  VH CDR2 of BCMA-51
WIYFASGNSEYNQKFTG

SEQ ID NO: 503 - protein, 10 aa, artificial
  VH CDR3 of BCMA-51
LYDYDWYFDV

SEQ ID NO: 504 - protein, 16 aa, artificial
  VL CDR1 of BCMA-51
KSSQSLVHSNGNTYLH

SEQ ID NO: 505 - protein, 7 aa, artificial
  VL CDR2 of BCMA-51
KVSNRFS

SEQ ID NO: 506 - protein, 9 aa, artificial
  VL CDR3 of BCMA-51
SQSTYPEFT

SEQ ID NO: 507 - protein, 119 aa, artificial; identical to SEQ ID NO: 487
  VH of BCMA-51

SEQ ID NO: 508 - protein, 112 aa, artificial
  VL of BCMA-51
DIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSTYPEFTFGQGTKLEIK

SEQ ID NO: 509 - protein, 246 aa, artificial
  BCMA-51 scFv
QVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSTYPEFTFGQGTKLEIK

SEQ ID NO: 510 - protein, 501 aa, artificial
  BCMA-51 HL x CD3 HL bispecific molecule
QVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSTYPEFTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 511 - protein, 5 aa, artificial
  VH CDR1 of BCMA-52
NAWMD

SEQ ID NO: 512 - protein, 19 aa, artificial
  VH CDR2 of BCMA-52
QITAKSNNYATYYAEPVKG

SEQ ID NO: 513 - protein, 4 aa, artificial
  VH CDR3 of BCMA-52
DGYH

SEQ ID NO: 514 - protein, 11 aa, artificial
  VL CDR1 of BCMA-52
RASEDIRNGLA

SEQ ID NO: 515 - protein, 7 aa, artificial
  VL CDR2 of BCMA-52
NANSLHT

SEQ ID NO: 516 - protein, 9 aa, artificial
  VL CDR3 of BCMA-52
EDTSKYPYT

SEQ ID NO: 517 - protein, 115 aa, artificial
  VH of BCMA-52
EVQLVESGGGLVKPGESLRLSCAASGFTFSNAWMDWVRQAPGKRLEWVAQITAKSNNYATYYAEPVKGRFTISRDDSKNTLYLQMNSLKTEDTAVYYCTDDGYHWGQGTLVTVSS

SEQ ID NO: 518 - protein, 107 aa, artificial
  VL of BCMA-52
AIQMTQSPSSLSASVGETVTIACRASEDIRNGLAWYQQKPGKAPKLLIYNANSLHTGVPSRFSGSGSGTEFTLKISSLQPEDEATYYCEDTSKYPYTFGQGTKLEIK

SEQ ID NO: 519 - protein, 237 aa, artificial
  BCMA-52 scFv
EVQLVESGGGLVKPGESLRLSCAASGFTFSNAWMDWVRQAPGKRLEWVAQITAKSNNYATYYAEPVKGRFTISRDDSKNTLYLQMNSLKTEDTAVYYCTDDGYHWGQGTLVTVSSGGGGSGGGGSGGGGSAIQMTQSPSSLSASVGETVTIACRASEDIRNGLAWYQQKPGKAPKLLIYNANSLHTGVPSRFSGSGSGTEFTLKISSLQPEDEATYYCEDTSKYPYTFGQGTKLEIK

SEQ ID NO: 520 - protein, 492 aa, artificial
  BCMA-52 HL x CD3 HL bispecific molecule
EVQLVESGGGLVKPGESLRLSCAASGFTFSNAWMDWVRQAPGKRLEWVAQITAKSNNYATYYAEPVKGRFTISRDDSKNTLYLQMNSLKTEDTAVYYCTDDGYHWGQGTLVTVSSGGGGSGGGGSGGGGSAIQMTQSPSSLSASVGETVTIACRASEDIRNGLAWYQQKPGKAPKLLIYNANSLHTGVPSRFSGSGSGTEFTLKISSLQPEDEATYYCEDTSKYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 521 - protein, 5 aa, artificial
  VH CDR1 of BCMA-53
NAWMD

SEQ ID NO: 522 - protein, 19 aa, artificial
  VH CDR2 of BCMA-53
QITAKSNNYATYYAAPVKG

SEQ ID NO: 523 - protein, 4 aa, artificial
  VH CDR3 of BCMA-53
DGYH

SEQ ID NO: 524 - protein, 11 aa, artificial
  VL CDR1 of BCMA-53
RASEDIRNGLA

SEQ ID NO: 525 - protein, 7 aa, artificial
  VL CDR2 of BCMA-53
NANSLHS

SEQ ID NO: 526 - protein, 9 aa, artificial
  VL CDR3 of BCMA-53
EDTSKYPYT

SEQ ID NO: 527 - protein, 115 aa, artificial
  VH of BCMA-53
EVQLVESGGGLVKPGESLRLSCAASGFTFSNAWMDWVRQAPGKRLEWIAQITAKSNNYATYYAAPVKGRFTISRDDSKNTLYLQMNSLKKEDTAVYYCTDDGYHWGQGTLVTVSS

SEQ ID NO: 528 - protein, 107 aa, artificial
  VL of BCMA-53
AIQMTQSPSSLSASVGDRVTIKCRASEDIRNGLAWYQQKPGKAPKLLIYNANSLHSGVPSRFSGSGSGTDFTLTISSMQPEDEGTYYCEDTSKYPYTFGQGTKLEIK

SEQ ID NO: 529 - protein, 237 aa, artificial
  BCMA-53 scFv
EVQLVESGGGLVKPGESLRLSCAASGFTFSNAWMDWVRQAPGKRLEWIAQITAKSNNYATYYAAPVKGRFTISRDDSKNTLYLQMNSLKKEDTAVYYCTDDGYHWGQGTLVTVSSGGGGSGGGGSGGGGSAIQMTQSPSSLSASVGDRVTIKCRASEDIRNGLAWYQQKPGKAPKLLIYNANSLHSGVPSRFSGSGSGTDFTLTISSMQPEDEGTYYCEDTSKYPYTFGQGTKLEIK

SEQ ID NO: 530 - protein, 492 aa, artificial
  BCMA-53 HL x CD3 HL bispecific molecule
EVQLVESGGGLVKPGESLRLSCAASGFTFSNAWMDWVRQAPGKRLEWIAQITAKSNNYATYYAAPVKGRFTISRDDSKNTLYLQMNSLKKEDTAVYYCTDDGYHWGQGTLVTVSSGGGGSGGGGSGGGGSAIQMTQSPSSLSASVGDRVTIKCRASEDIRNGLAWYQQKPGKAPKLLIYNANSLHSGVPSRFSGSGSGTDFTLTISSMQPEDEGTYYCEDTSKYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 531 - protein, 5 aa, artificial
  VH CDR1 of BCMA-54
NAWMD

SEQ ID NO: 532 - protein, 19 aa, artificial
  VH CDR2 of BCMA-54
QITAKSNNYATYYAAPVKG

SEQ ID NO: 533 - protein, 4 aa, artificial
  VH CDR3 of BCMA-54
DGYH

SEQ ID NO: 534 - protein, 11 aa, artificial
  VL CDR1 of BCMA-54
RASEDIRNGLA

SEQ ID NO: 535 - protein, 7 aa, artificial
  VL CDR2 of BCMA-54
NANSLHT

SEQ ID NO: 536 - protein, 9 aa, artificial
  VL CDR3 of BCMA-54
EDTSKYPYT

SEQ ID NO: 537 - protein, 115 aa, artificial; identical to SEQ ID NO: 527
  VH of BCMA-54

SEQ ID NO: 538 - protein, 107 aa, artificial
  VL of BCMA-54
AIQMTQSPSSLSASVGDRVTIACRASEDIRNGLAWYQQKPGKAPKLLIYNANSLHTGVPSRFSGSGSGTDFTLTISSLQPEDEAIYYCEDTSKYPYTFGQGTKLEIK

SEQ ID NO: 539 - protein, 237 aa, artificial
  BCMA-54 scFv
EVQLVESGGGLVKPGESLRLSCAASGFTFSNAWMDWVRQAPGKRLEWIAQITAKSNNYATYYAAPVKGRFTISRDDSKNTLYLQMNSLKKEDTAVYYCTDDGYHWGQGTLVTVSSGGGGSGGGGSGGGGSAIQMTQSPSSLSASVGDRVTIACRASEDIRNGLAWYQQKPGKAPKLLIYNANSLHTGVPSRFSGSGSGTDFTLTISSLQPEDEAIYYCEDTSKYPYTFGQGTKLEIK

SEQ ID NO: 540 - protein, 492 aa, artificial
  BCMA-54 HL x CD3 HL bispecific molecule
EVQLVESGGGLVKPGESLRLSCAASGFTFSNAWMDWVRQAPGKRLEWIAQITAKSNNYATYYAAPVKGRFTISRDDSKNTLYLQMNSLKKEDTAVYYCTDDGYHWGQGTLVTVSSGGGGSGGGGSGGGGSAIQMTQSPSSLSASVGDRVTIACRASEDIRNGLAWYQQKPGKAPKLLIYNANSLHTGVPSRFSGSGSGTDFTLTISSLQPEDEAIYYCEDTSKYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 541 - protein, 5 aa, artificial
  VH CDR1 of BCMA-55
NAWMD

SEQ ID NO: 542 - protein, 19 aa, artificial
  VH CDR2 of BCMA-55
QITAKSNNYATYYAAPVKG

SEQ ID NO: 543 - protein, 4 aa, artificial
  VH CDR3 of BCMA-55
DGYH

SEQ ID NO: 544 - protein, 11 aa, artificial
  VL CDR1 of BCMA-55
RASEDIRNGLA

SEQ ID NO: 545 - protein, 7 aa, artificial
  VL CDR2 of BCMA-55
NANSLHT

SEQ ID NO: 546 - protein, 9 aa, artificial
  VL CDR3 of BCMA-55
EETLKYPYT

SEQ ID NO: 547 - protein, 115 aa, artificial
  VH of BCMA-55
EVQLVESGGSLVKPGGSLRLSCAASGFTFSNAWMDWVRQAPGKRLEWVAQITAKSNNYATYYAAPVKGRFTISRDDSKNTLYLQMNSLKEEDTAVYYCTDDGYHWGQGTLVTVSS

SEQ ID NO: 548 - protein, 107 aa, artificial
  VL of BCMA-55
AIQMTQSPSSLSASVGDRVTIACRASEDIRNGLAWYQQKPGKAPKLLIYNANSLHTGVPSRFSGSGSGTDFTLTISNLQPEDEATYYCEETLKYPYTFGQGTKLEIK

SEQ ID NO: 549 - protein, 237 aa, artificial
  BCMA-55 scFv
EVQLVESGGSLVKPGGSLRLSCAASGFTFSNAWMDWVRQAPGKRLEWVAQITAKSNNYATYYAAPVKGRFTISRDDSKNTLYLQMNSLKEEDTAVYYCTDDGYHWGQGTLVTVSSGGGGSGGGGSGGGGSAIQMTQSPSSLSASVGDRVTIACRASEDIRNGLAWYQQKPGKAPKLLIYNANSLHTGVPSRFSGSGSGTDFTLTISNLQPEDEATYYCEETLKYPYTFGQGTKLEIK

SEQ ID NO: 550 - protein, 492 aa, artificial
  BCMA-55 HL x CD3 HL bispecific molecule
EVQLVESGGSLVKPGGSLRLSCAASGFTFSNAWMDWVRQAPGKRLEWVAQITAKSNNYATYYAAPVKGRFTISRDDSKNTLYLQMNSLKEEDTAVYYCTDDGYHWGQGTLVTVSSGGGGSGGGGSGGGGSAIQMTQSPSSLSASVGDRVTIACRASEDIRNGLAWYQQKPGKAPKLLIYNANSLHTGVPSRFSGSGSGTDFTLTISNLQPEDEATYYCEETLKYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 551 - protein, 5 aa, artificial
  VH CDR1 of BCMA-56
NAWMD

SEQ ID NO: 552 - protein, 19 aa, artificial
  VH CDR2 of BCMA-56
QITAKSNNYATYYAEPVKG

SEQ ID NO: 553 - protein, 4 aa, artificial
  VH CDR3 of BCMA-56
DGYH

SEQ ID NO: 554 - protein, 11 aa, artificial
  VL CDR1 of BCMA-56
RASEDIRNGLA

SEQ ID NO: 555 - protein, 7 aa, artificial
  VL CDR2 of BCMA-56
NANSLHT

SEQ ID NO: 556 - protein, 9 aa, artificial
  VL CDR3 of BCMA-56
EETLKYPYT

SEQ ID NO: 557 - protein, 115 aa, artificial; identical to SEQ ID NO: 517
  VH of BCMA-56

SEQ ID NO: 558 - protein, 107 aa, artificial
  VL of BCMA-56
AIQMTQSPSSLSASVGETVTIACRASEDIRNGLAWYQQKPGKAPKLLIYNANSLHTGVPSRFSGSGSGTEFTLKISSLQPEDEATYYCEETLKYPYTFGQGTKLEIK

SEQ ID NO: 559 - protein, 237 aa, artificial
  BCMA-56 scFv
EVQLVESGGGLVKPGESLRLSCAASGFTFSNAWMDWVRQAPGKRLEWVAQITAKSNNYATYYAEPVKGRFTISRDDSKNTLYLQMNSLKTEDTAVYYCTDDGYHWGQGTLVTVSSGGGGSGGGGSGGGGSAIQMTQSPSSLSASVGETVTIACRASEDIRNGLAWYQQKPGKAPKLLIYNANSLHTGVPSRFSGSGSGTEFTLKISSLQPEDEATYYCEETLKYPYTFGQGTKLEIK

SEQ ID NO: 560 - protein, 492 aa, artificial
  BCMA-56 HL x CD3 HL bispecific molecule
EVQLVESGGGLVKPGESLRLSCAASGFTFSNAWMDWVRQAPGKRLEWVAQITAKSNNYATYYAEPVKGRFTISRDDSKNTLYLQMNSLKTEDTAVYYCTDDGYHWGQGTLVTVSSGGGGSGGGGSGGGGSAIQMTQSPSSLSASVGETVTIACRASEDIRNGLAWYQQKPGKAPKLLIYNANSLHTGVPSRFSGSGSGTEFTLKISSLQPEDEATYYCEETLKYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 561 - protein, 5 aa, artificial
  VH CDR1 of BCMA-57
NAWMD

SEQ ID NO: 562 - protein, 19 aa, artificial
  VH CDR2 of BCMA-57
QITAKSNNYATYYAAPVKG

SEQ ID NO: 563 - protein, 4 aa, artificial
  VH CDR3 of BCMA-57
DGYH

SEQ ID NO: 564 - protein, 11 aa, artificial
  VL CDR1 of BCMA-57
RASEDIRNGLA

SEQ ID NO: 565 - protein, 7 aa, artificial
  VL CDR2 of BCMA-57
NANSLHT

SEQ ID NO: 566 - protein, 9 aa, artificial
  VL CDR3 of BCMA-57
EETLKYPYT

SEQ ID NO: 567 - protein, 115 aa, artificial; identical to SEQ ID NO: 527
  VH of BCMA-57

SEQ ID NO: 568 - protein, 107 aa, artificial
  VL of BCMA-57
AIQMTQSPSSLSASVGDRVTIACRASEDIRNGLAWYQQKPGKAPKLLIYNANSLHTGVPSRFSGSGSGTDFTLTISSLQPEDEAIYYCEETLKYPYTFGQGTKLEIK

SEQ ID NO: 569 - protein, 237 aa, artificial
  BCMA-57 scFv
EVQLVESGGGLVKPGESLRLSCAASGFTFSNAWMDWVRQAPGKRLEWIAQITAKSNNYATYYAAPVKGRFTISRDDSKNTLYLQMNSLKKEDTAVYYCTDDGYHWGQGTLVTVSSGGGGSGGGGSGGGGSAIQMTQSPSSLSASVGDRVTIACRASEDIRNGLAWYQQKPGKAPKLLIYNANSLHTGVPSRFSGSGSGTDFTLTISSLQPEDEAIYYCEETLKYPYTFGQGTKLEIK

SEQ ID NO: 570 - protein, 492 aa, artificial
  BCMA-57 HL x CD3 HL bispecific molecule
EVQLVESGGGLVKPGESLRLSCAASGFTFSNAWMDWVRQAPGKRLEWIAQITAKSNNYATYYAAPVKGRFTISRDDSKNTLYLQMNSLKKEDTAVYYCTDDGYHWGQGTLVTVSSGGGGSGGGGSGGGGSAIQMTQSPSSLSASVGDRVTIACRASEDIRNGLAWYQQKPGKAPKLLIYNANSLHTGVPSRFSGSGSGTDFTLTISSLQPEDEAIYYCEETLKYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 571 - protein, 5 aa, artificial
  VH CDR1 of BCMA-58
NAWMD

SEQ ID NO: 572 - protein, 19 aa, artificial
  VH CDR2 of BCMA-58
QITAKSNNYATYYAAPVKG

SEQ ID NO: 573 - protein, 4 aa, artificial
  VH CDR3 of BCMA-58
DGYH

SEQ ID NO: 574 - protein, 11 aa, artificial
  VL CDR1 of BCMA-58
RASEDIRNGLA

SEQ ID NO: 575 - protein, 7 aa, artificial
  VL CDR2 of BCMA-58
NANSLHS

SEQ ID NO: 576 - protein, 9 aa, artificial
  VL CDR3 of BCMA-58
EETLKYPYT

SEQ ID NO: 577 - protein, 115 aa, artificial; identical to SEQ ID NO: 527
  VH of BCMA-58

SEQ ID NO: 578 - protein, 107 aa, artificial
  VL of BCMA-58
AIQMTQSPSSLSASVGDRVTIKCRASEDIRNGLAWYQQKPGKAPKLLIYNANSLHSGVPSRFSGSGSGTDFTLTISSMQPEDEGTYYCEETLKYPYTFGQGTKLEIK

SEQ ID NO: 579 - protein, 237 aa, artificial
  BCMA-58 scFv
EVQLVESGGGLVKPGESLRLSCAASGFTFSNAWMDWVRQAPGKRLEWIAQITAKSNNYATYYAAPVKGRFTISRDDSKNTLYLQMNSLKKEDTAVYYCTDDGYHWGQGTLVTVSSGGGGSGGGGSGGGGSAIQMTQSPSSLSASVGDRVTIKCRASEDIRNGLAWYQQKPGKAPKLLIYNANSLHSGVPSRFSGSGSGTDFTLTISSMQPEDEGTYYCEETLKYPYTFGQGTKLEIK

SEQ ID NO: 580 - protein, 492 aa, artificial
  BCMA-58 HL x CD3 HL bispecific molecule
EVQLVESGGGLVKPGESLRLSCAASGFTFSNAWMDWVRQAPGKRLEWIAQITAKSNNYATYYAAPVKGRFTISRDDSKNTLYLQMNSLKKEDTAVYYCTDDGYHWGQGTLVTVSSGGGGSGGGGSGGGGSAIQMTQSPSSLSASVGDRVTIKCRASEDIRNGLAWYQQKPGKAPKLLIYNANSLHSGVPSRFSGSGSGTDFTLTISSMQPEDEGTYYCEETLKYPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 581 - protein, 5 aa, artificial
  VH CDR1 of BCMA-59
NYDMA

SEQ ID NO: 582 - protein, 17 aa, artificial
  VH CDR2 of BCMA-59
SIITSGGDNYYRDSVKG

SEQ ID NO: 583 - protein, 12 aa, artificial
  VH CDR3 of BCMA-59
HDYYDGSYGFAY

SEQ ID NO: 584 - protein, 11 aa, artificial
  VL CDR1 of BCMA-59
KASQSVGINVD

SEQ ID NO: 585 - protein, 7 aa, artificial
  VL CDR2 of BCMA-59
GASNRHT

SEQ ID NO: 586 - protein, 9 aa, artificial
  VL CDR3 of BCMA-59
LQYGSIPFT

SEQ ID NO: 587 - protein, 121 aa, artificial
  VH of BCMA-59
QVQLVESGGGVVQPGRSLRLSCAASGFTFSNYDMAWVRQAPGKGLEWVASIITSGGDNYYRDSVKGRFTISRDNAKNTLYLQMNSLRAEDTAVYYCVRHDYYDGSYGFAYWGQGTLVTVSS

SEQ ID NO: 588 - protein, 107 aa, artificial; identical to SEQ ID NO: 48
  VL of BCMA-59

SEQ ID NO: 589 - protein, 243 aa, artificial
  BCMA-59 scFv
QVQLVESGGGVVQPGRSLRLSCAASGFTFSNYDMAWVRQAPGKGLEWVASIITSGGDNYYRDSVKGRFTISRDNAKNTLYLQMNSLRAEDTAVYYCVRHDYYDGSYGFAYWGQGTLVTVSSGGGGSGGGGSGGGGSEIVMTQSPASMSVSPGERATLSCKASQSVGINVDWYQQKPGQAPRLLIYGASNRHTGIPARFSGSGSGTEFTLTISSLQSEDFAVYYCLQYGSIPFTFGPGTKVDIK

SEQ ID NO: 590 - protein, 498 aa, artificial
  BCMA-59 HL x CD3 HL bispecific molecule
QVQLVESGGGVVQPGRSLRLSCAASGFTFSNYDMAWVRQAPGKGLEWVASIITSGGDNYYRDSVKGRFTISRDNAKNTLYLQMNSLRAEDTAVYYCVRHDYYDGSYGFAYWGQGTLVTVSSGGGGSGGGGSGGGGSEIVMTQSPASMSVSPGERATLSCKASQSVGINVDWYQQKPGQAPRLLIYGASNRHTGIPARFSGSGSGTEFTLTISSLQSEDFAVYYCLQYGSIPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 591 - protein, 5 aa, artificial
  VH CDR1 of BCMA-60
NYDMA

SEQ ID NO: 592 - protein, 17 aa, artificial
  VH CDR2 of BCMA-60
SIITSGGDNYYRDSVKG

SEQ ID NO: 593 - protein, 12 aa, artificial
  VH CDR3 of BCMA-60
HDYYDGSYGFAY

SEQ ID NO: 594 - protein, 11 aa, artificial
  VL CDR1 of BCMA-60
KASQSVGINVD

SEQ ID NO: 595 - protein, 7 aa, artificial
  VL CDR2 of BCMA-60
GASNRHT

SEQ ID NO: 596 - protein, 9 aa, artificial
  VL CDR3 of BCMA-60
LQYGSIPFT

SEQ ID NO: 597 - protein, 121 aa, artificial
  VH of BCMA-60
QVQLVESGGGVVQPGRSLRLSCAASGFTFSNYDMAWVRQAPGKGLEWVASIITSGGDNYYRDSVKGRFTISRDNSKNTLYLQMNSLRAEDTAVYYCVRHDYYDGSYGFAYWGQGTLVTVSS

SEQ ID NO: 598 - protein, 107 aa, artificial; identical to SEQ ID NO: 8
  VL of BCMA-60

SEQ ID NO: 599 - protein, 243 aa, artificial
  BCMA-60 scFv
QVQLVESGGGVVQPGRSLRLSCAASGFTFSNYDMAWVRQAPGKGLEWVASIITSGGDNYYRDSVKGRFTISRDNSKNTLYLQMNSLRAEDTAVYYCVRHDYYDGSYGFAYWGQGTLVTVSSGGGGSGGGGSGGGGSEIVMTQSPATLSVSPGERVTLSCKASQSVGINVDWYQQKPGQAPRLLIYGASNRHTGIPARFSGSGSGREFTLTISSLQSEDFAVYYCLQYGSIPFTFGPGTKVDIK

SEQ ID NO: 600 - protein, 498 aa, artificial
  BCMA-60 HL x CD3 HL bispecific molecule
QVQLVESGGGVVQPGRSLRLSCAASGFTFSNYDMAWVRQAPGKGLEWVASIITSGGDNYYRDSVKGRFTISRDNSKNTLYLQMNSLRAEDTAVYYCVRHDYYDGSYGFAYWGQGTLVTVSSGGGGSGGGGSGGGGSEIVMTQSPATLSVSPGERVTLSCKASQSVGINVDWYQQKPGQAPRLLIYGASNRHTGIPARFSGSGSGREFTLTISSLQSEDFAVYYCLQYGSIPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 601 - protein, 5 aa, artificial
  VH CDR1 of BCMA-61
NYDMA

SEQ ID NO: 602 - protein, 17 aa, artificial
  VH CDR2 of BCMA-61
SIITSGGDNYYRDSVKG

SEQ ID NO: 603 - protein, 12 aa, artificial
  VH CDR3 of BCMA-61
HDYYDGSYGFAY

SEQ ID NO: 604 - protein, 11 aa, artificial
  VL CDR1 of BCMA-61
KASQSVGINVD

SEQ ID NO: 605 - protein, 7 aa, artificial
  VL CDR2 of BCMA-61
GASNRHT

SEQ ID NO: 606 - protein, 9 aa, artificial
  VL CDR3 of BCMA-61
LQYGSIPFT

SEQ ID NO: 607 - protein, 121 aa, artificial
  VH of BCMA-61
QVQLVESGGGVVQPGRSLRLSCAASGFTFSNYDMAWVRQAPGKGLEWVASIITSGGDNYYRDSVKGRFTISRDNSKNTLYLQMNSLRSEDTAVYYCVRHDYYDGSYGFAYWGQGTLVTVSS

SEQ ID NO: 608 - protein, 107 aa, artificial; identical to SEQ ID NO: 28
  VL of BCMA-61

SEQ ID NO: 609 - protein, 243 aa, artificial
  BCMA-61 scFv
QVQLVESGGGVVQPGRSLRLSCAASGFTFSNYDMAWVRQAPGKGLEWVASIITSGGDNYYRDSVKGRFTISRDNSKNTLYLQMNSLRSEDTAVYYCVRHDYYDGSYGFAYWGQGTLVTVSSGGGGSGGGGSGGGGSEIVMTQSPATLSVSPGERVTLSCKASQSVGINVDWYQQKPGQAPRLLIYGASNRHTGIPARFSGSGSGTEFTLTISSLQSEDFAVYYCLQYGSIPFTFGPGTKVDIK

SEQ ID NO: 610 - protein, 498 aa, artificial
  BCMA-61 HL x CD3 HL bispecific molecule
QVQLVESGGGVVQPGRSLRLSCAASGFTFSNYDMAWVRQAPGKGLEWVASIITSGGDNYYRDSVKGRFTISRDNSKNTLYLQMNSLRSEDTAVYYCVRHDYYDGSYGFAYWGQGTLVTVSSGGGGSGGGGSGGGGSEIVMTQSPATLSVSPGERVTLSCKASQSVGINVDWYQQKPGQAPRLLIYGASNRHTGIPARFSGSGSGTEFTLTISSLQSEDFAVYYCLQYGSIPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 611 - protein, 5 aa, artificial
  VH CDR1 of BCMA-62
NYDMA

SEQ ID NO: 612 - protein, 17 aa, artificial
  VH CDR2 of BCMA-62
SIITSGGDNYYRDSVKG

SEQ ID NO: 613 - protein, 12 aa, artificial
  VH CDR3 of BCMA-62
HDYYDGSYGFAY

SEQ ID NO: 614 - protein, 11 aa, artificial
  VL CDR1 of BCMA-62
KASQSVGINVD

SEQ ID NO: 615 - protein, 7 aa, artificial
  VL CDR2 of BCMA-62
GASNRHT

SEQ ID NO: 616 - protein, 9 aa, artificial
  VL CDR3 of BCMA-62
LQYGSIPFT

SEQ ID NO: 617 - protein, 121 aa, artificial
  VH of BCMA-62
QVQLVESGGGVVQPGRSLRLSCAASGFTFSNYDMAWVRQAPGKGLEWVASIITSGGDNYYRDSVKGRFTVSRDNSKNTLYLQMNSLRAEDTAVYYCVRHDYYDGSYGFAYWGQGTLVTVSS

SEQ ID NO: 618 - protein, 107 aa, artificial; identical to SEQ ID NO: 68
  VL of BCMA-62

SEQ ID NO: 619 - protein, 243 aa, artificial
  BCMA-62 scFv
QVQLVESGGGVVQPGRSLRLSCAASGFTFSNYDMAWVRQAPGKGLEWVASIITSGGDNYYRDSVKGRFTVSRDNSKNTLYLQMNSLRAEDTAVYYCVRHDYYDGSYGFAYWGQGTLVTVSSGGGGSGGGGSGGGGSEIVMTQSPATLSVSPGERATLSCKASQSVGINVDWYQQKPGQAPRLLIYGASNRHTGIPARFSGSGSGTEFTLTISSLQAEDFAVYYCLQYGSIPFTFGPGTKVDIK

SEQ ID NO: 620 - protein, 498 aa, artificial
  BCMA-62 HL x CD3 HL bispecific molecule
QVQLVESGGGVVQPGRSLRLSCAASGFTFSNYDMAWVRQAPGKGLEWVASIITSGGDNYYRDSVKGRFTVSRDNSKNTLYLQMNSLRAEDTAVYYCVRHDYYDGSYGFAYWGQGTLVTVSSGGGGSGGGGSGGGGSEIVMTQSPATLSVSPGERATLSCKASQSVGINVDWYQQKPGQAPRLLIYGASNRHTGIPARFSGSGSGTEFTLTISSLQAEDFAVYYCLQYGSIPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 621 - protein, 5 aa, artificial
  VH CDR1 of BCMA-63
NYDMA

SEQ ID NO: 622 - protein, 17 aa, artificial
  VH CDR2 of BCMA-63
SISTRGDITSYRDSVKG

SEQ ID NO: 623 - protein, 12 aa, artificial
  VH CDR3 of BCMA-63
QDYYTDYMGFAY

SEQ ID NO: 624 - protein, 11 aa, artificial
  VL CDR1 of BCMA-63
RASEDIYNGLA

SEQ ID NO: 625 - protein, 7 aa, artificial
  VL CDR2 of BCMA-63
GASSLQD

SEQ ID NO: 626 - protein, 9 aa, artificial
  VL CDR3 of BCMA-63
QQSYKYPLT

SEQ ID NO: 627 - protein, 121 aa, artificial
  VH of BCMA-63
EVQLLESGGGLVQPGGSLRLSCAASGFTFSNYDMAWVRQAPGKGLEWVSSISTRGDITSYRDSVKGRFTISRDNAKNTLYLQMNSLRAEDTAVYYCARQDYYTDYMGFAYWGQGTLVTVSS

SEQ ID NO: 628 - protein, 107 aa, artificial
  VL of BCMA-63
AIQMTQSPSSLSASVGDTVTITCRASEDIYNGLAWYQQKPGKAPKLLIYGASSLQDGVPSRFSGSGSGTDYTLTISSLQPEDEATYYCQQSYKYPLTFGGGTKVEIK

SEQ ID NO: 629 - protein, 243 aa, artificial
  BCMA-63 scFv
EVQLLESGGGLVQPGGSLRLSCAASGFTFSNYDMAWVRQAPGKGLEWVSSISTRGDITSYRDSVKGRFTISRDNAKNTLYLQMNSLRAEDTAVYYCARQDYYTDYMGFAYWGQGTLVTVSSGGGGSGGGGSGGGGSAIQMTQSPSSLSASVGDTVTITCRASEDIYNGLAWYQQKPGKAPKLLIYGASSLQDGVPSRFSGSGSGTDYTLTISSLQPEDEATYYCQQSYKYPLTFGGGTKVEIK

SEQ ID NO: 630 - protein, 498 aa, artificial
  BCMA-63 HL x CD3 HL bispecific molecule
EVQLLESGGGLVQPGGSLRLSCAASGFTFSNYDMAWVRQAPGKGLEWVSSISTRGDITSYRDSVKGRFTISRDNAKNTLYLQMNSLRAEDTAVYYCARQDYYTDYMGFAYWGQGTLVTVSSGGGGSGGGGSGGGGSAIQMTQSPSSLSASVGDTVTITCRASEDIYNGLAWYQQKPGKAPKLLIYGASSLQDGVPSRFSGSGSGTDYTLTISSLQPEDEATYYCQQSYKYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 631 - protein, 5 aa, artificial
  VH CDR1 of BCMA-64
NYDMA

SEQ ID NO: 632 - protein, 17 aa, artificial
  VH CDR2 of BCMA-64
SISTRGDITSYRDSVKG

SEQ ID NO: 633 - protein, 12 aa, artificial
  VH CDR3 of BCMA-64
QDYYTDYMGFAY

SEQ ID NO: 634 - protein, 11 aa, artificial
  VL CDR1 of BCMA-64
RASEDIYNGLA

SEQ ID NO: 635 - protein, 7 aa, artificial
  VL CDR2 of BCMA-64
GASSLQD

SEQ ID NO: 636 - protein, 9 aa, artificial
  VL CDR3 of BCMA-64
QQSYKYPLT

SEQ ID NO: 637 - protein, 121 aa, artificial
  VH of BCMA-64
EVQLLESGGGLVQPGRSLRLSCAASGFTFSNYDMAWVRQAPGKGLEWVSSISTRGDITSYRDSVKGRFTISRDNSKNTLYLQMNSLRAEDTAVYYCARQDYYTDYMGFAYWGQGTLVTVSS

SEQ ID NO: 638 - protein, 107 aa, artificial
  VL of BCMA-64
AIQMTQSPSSLSASVGDRVTITCRASEDIYNGLAWYQQKPGKAPKLLIYGASSLQDGVPSRFSGSGSGTDFTLTISSMQPEDEATYYCQQSYKYPLTFGGGTKVEIK

SEQ ID NO: 639 - protein, 243 aa, artificial
  BCMA-64 scFv
EVQLLESGGGLVQPGRSLRLSCAASGFTFSNYDMAWVRQAPGKGLEWVSSISTRGDITSYRDSVKGRFTISRDNSKNTLYLQMNSLRAEDTAVYYCARQDYYTDYMGFAYWGQGTLVTVSSGGGGSGGGGSGGGGSAIQMTQSPSSLSASVGDRVTITCRASEDIYNGLAWYQQKPGKAPKLLIYGASSLQDGVPSRFSGSGSGTDFTLTISSMQPEDEATYYCQQSYKYPLTFGGGTKVEIK

SEQ ID NO: 640 - protein, 498 aa, artificial
  BCMA-64 HL x CD3 HL bispecific molecule
EVQLLESGGGLVQPGRSLRLSCAASGFTFSNYDMAWVRQAPGKGLEWVSSISTRGDITSYRDSVKGRFTISRDNSKNTLYLQMNSLRAEDTAVYYCARQDYYTDYMGFAYWGQGTLVTVSSGGGGSGGGGSGGGGSAIQMTQSPSSLSASVGDRVTITCRASEDIYNGLAWYQQKPGKAPKLLIYGASSLQDGVPSRFSGSGSGTDFTLTISSMQPEDEATYYCQQSYKYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 641 - protein, 5 aa, artificial
  VH CDR1 of BCMA-65
NYDMA

SEQ ID NO: 642 - protein, 17 aa, artificial
  VH CDR2 of BCMA-65
SISTRGDITSYRDSVKG

SEQ ID NO: 643 - protein, 12 aa, artificial
  VH CDR3 of BCMA-65
QDYYTDYMGFAY

SEQ ID NO: 644 - protein, 11 aa, artificial
  VL CDR1 of BCMA-65
RASEDIYNGLA

SEQ ID NO: 645 - protein, 7 aa, artificial
  VL CDR2 of BCMA-65
GASSLQD

SEQ ID NO: 646 - protein, 9 aa, artificial
  VL CDR3 of BCMA-65
QQSYKYPLT

SEQ ID NO: 647 - protein, 121 aa, artificial
  VH of BCMA-65
EVQLLESGGGLVQPGGSLRLSCAASGFTFSNYDMAWVRQAPGKGLEWVSSISTRGDITSYRDSVKGRFTISRDNSKNTLYLQMNSLRAEDTAVYYCARQDYYTDYMGFAYWGQGTLVTVSS

SEQ ID NO: 648 - protein, 107 aa, artificial
  VL of BCMA-65
AIQMTQSPSSLSASVGDRVTITCRASEDIYNGLAWYQQKPGKAPKLLIYGASSLQDGVPSRFSGSGSGTHYTLTISSLQPEDEATYYCQQSYKYPLTFGGGTKVEIK

SEQ ID NO: 649 - protein, 243 aa, artificial
  BCMA-65 scFv
EVQLLESGGGLVQPGGSLRLSCAASGFTFSNYDMAWVRQAPGKGLEWVSSISTRGDITSYRDSVKGRFTISRDNSKNTLYLQMNSLRAEDTAVYYCARQDYYTDYMGFAYWGQGTLVTVSSGGGGSGGGGSGGGGSAIQMTQSPSSLSASVGDRVTITCRASEDIYNGLAWYQQKPGKAPKLLIYGASSLQDGVPSRFSGSGSGTHYTLTISSLQPEDEATYYCQQSYKYPLTFGGGTKVEIK

SEQ ID NO: 650 - protein, 498 aa, artificial
  BCMA-65 HL x CD3 HL bispecific molecule
EVQLLESGGGLVQPGGSLRLSCAASGFTFSNYDMAWVRQAPGKGLEWVSSISTRGDITSYRDSVKGRFTISRDNSKNTLYLQMNSLRAEDTAVYYCARQDYYTDYMGFAYWGQGTLVTVSSGGGGSGGGGSGGGGSAIQMTQSPSSLSASVGDRVTITCRASEDIYNGLAWYQQKPGKAPKLLIYGASSLQDGVPSRFSGSGSGTHYTLTISSLQPEDEATYYCQQSYKYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 651 - protein, 5 aa, artificial
  VH CDR1 of BCMA-66
NYDMA

SEQ ID NO: 652 - protein, 17 aa, artificial
  VH CDR2 of BCMA-66
SISTRGDITSYRDSVKG

SEQ ID NO: 653 - protein, 12 aa, artificial
  VH CDR3 of BCMA-66
QDYYTDYMGFAY

SEQ ID NO: 654 - protein, 11 aa, artificial
  VL CDR1 of BCMA-66
RASEDIYNGLA

SEQ ID NO: 655 - protein, 7 aa, artificial
  VL CDR2 of BCMA-66
GASSLQD

SEQ ID NO: 656 - protein, 9 aa, artificial
  VL CDR3 of BCMA-66
AGPHKYPLT

SEQ ID NO: 657 - protein, 121 aa, artificial; identical to SEQ ID NO: 627
  VH of BCMA-66

SEQ ID NO: 658 - protein, 107 aa, artificial
  VL of BCMA-66
AIQMTQSPSSLSASVGDTVTITCRASEDIYNGLAWYQQKPGKAPKLLIYGASSLQDGVPSRFSGSGSGTDYTLTISSLQPEDEATYYCAGPHKYPLTFGGGTKVEIK

SEQ ID NO: 659 - protein, 243 aa, artificial
  BCMA-66 scFv
EVQLLESGGGLVQPGGSLRLSCAASGFTFSNYDMAWVRQAPGKGLEWVSSISTRGDITSYRDSVKGRFTISRDNAKNTLYLQMNSLRAEDTAVYYCARQDYYTDYMGFAYWGQGTLVTVSSGGGGSGGGGSGGGGSAIQMTQSPSSLSASVGDTVTITCRASEDIYNGLAWYQQKPGKAPKLLIYGASSLQDGVPSRFSGSGSGTDYTLTISSLQPEDEATYYCAGPHKYPLTFGGGTKVEIK

SEQ ID NO: 660 - protein, 498 aa, artificial
  BCMA-66 HL x CD3 HL bispecific molecule
EVQLLESGGGLVQPGGSLRLSCAASGFTFSNYDMAWVRQAPGKGLEWVSSISTRGDITSYRDSVKGRFTISRDNAKNTLYLQMNSLRAEDTAVYYCARQDYYTDYMGFAYWGQGTLVTVSSGGGGSGGGGSGGGGSAIQMTQSPSSLSASVGDTVTITCRASEDIYNGLAWYQQKPGKAPKLLIYGASSLQDGVPSRFSGSGSGTDYTLTISSLQPEDEATYYCAGPHKYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 661 - protein, 5 aa, artificial
  VH CDR1 of BCMA-67
NYDMA

SEQ ID NO: 662 - protein, 17 aa, artificial
  VH CDR2 of BCMA-67
SISTRGDITSYRDSVKG

SEQ ID NO: 663 - protein, 12 aa, artificial
  VH CDR3 of BCMA-67
QDYYTDYMGFAY

SEQ ID NO: 664 - protein, 11 aa, artificial
  VL CDR1 of BCMA-67
RASEDIYNGLA

SEQ ID NO: 665 - protein, 7 aa, artificial
  VL CDR2 of BCMA-67
GASSLQD

SEQ ID NO: 666 - protein, 9 aa, artificial
  VL CDR3 of BCMA-67
AGPHKYPLT

SEQ ID NO: 667 - protein, 121 aa, artificial; identical to SEQ ID NO: 647
  VH of BCMA-67

SEQ ID NO: 668 - protein, 107 aa, artificial
  VL of BCMA-67
AIQMTQSPSSLSASVGDRVTITCRASEDIYNGLAWYQQKPGKAPKLLIYGASSLQDGVPSRFSGSGSGTHYTLTISSLQPEDEATYYCAGPHKYPLTFGGGTKVEIK

SEQ ID NO: 669 - protein, 243 aa, artificial
  BCMA-67 scFv
EVQLLESGGGLVQPGGSLRLSCAASGFTFSNYDMAWVRQAPGKGLEWVSSISTRGDITSYRDSVKGRFTISRDNSKNTLYLQMNSLRAEDTAVYYCARQDYYTDYMGFAYWGQGTLVTVSSGGGGSGGGGSGGGGSAIQMTQSPSSLSASVGDRVTITCRASEDIYNGLAWYQQKPGKAPKLLIYGASSLQDGVPSRFSGSGSGTHYTLTISSLQPEDEATYYCAGPHKYPLTFGGGTKVEIK

SEQ ID NO: 670 - protein, 498 aa, artificial
  BCMA-67 HL x CD3 HL bispecific molecule
EVQLLESGGGLVQPGGSLRLSCAASGFTFSNYDMAWVRQAPGKGLEWVSSISTRGDITSYRDSVKGRFTISRDNSKNTLYLQMNSLRAEDTAVYYCARQDYYTDYMGFAYWGQGTLVTVSSGGGGSGGGGSGGGGSAIQMTQSPSSLSASVGDRVTITCRASEDIYNGLAWYQQKPGKAPKLLIYGASSLQDGVPSRFSGSGSGTHYTLTISSLQPEDEATYYCAGPHKYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 671 - protein, 5 aa, artificial
  VH CDR1 of BCMA-68
NYDMA

SEQ ID NO: 672 - protein, 17 aa, artificial
  VH CDR2 of BCMA-68
SISTRGDITSYRDSVKG

SEQ ID NO: 673 - protein, 12 aa, artificial
  VH CDR3 of BCMA-68
QDYYTDYMGFAY

SEQ ID NO: 674 - protein, 11 aa, artificial
  VL CDR1 of BCMA-68
RASEDIYNGLA

SEQ ID NO: 675 - protein, 7 aa, artificial
  VL CDR2 of BCMA-68
GASSLQD

SEQ ID NO: 676 - protein, 9 aa, artificial
  VL CDR3 of BCMA-68
QQSRNYQQT

SEQ ID NO: 677 - protein, 121 aa, artificial; identical to SEQ ID NO: 627
  VH of BCMA-68

SEQ ID NO: 678 - protein, 107 aa, artificial
  VL of BCMA-68
AIQMTQSPSSLSASVGDTVTITCRASEDIYNGLAWYQQKPGKAPKLLIYGASSLQDGVPSRFSGSGSGTDYTLTISSLQPEDEATYYCQQSRNYQQTFGGGTKVEIK

SEQ ID NO: 679 - protein, 243 aa, artificial
  BCMA-68 scFv
EVQLLESGGGLVQPGGSLRLSCAASGFTFSNYDMAWVRQAPGKGLEWVSSISTRGDITSYRDSVKGRFTISRDNAKNTLYLQMNSLRAEDTAVYYCARQDYYTDYMGFAYWGQGTLVTVSSGGGGSGGGGSGGGGSAIQMTQSPSSLSASVGDTVTITCRASEDIYNGLAWYQQKPGKAPKLLIYGASSLQDGVPSRFSGSGSGTDYTLTISSLQPEDEATYYCQQSRNYQQTFGGGTKVEIK

SEQ ID NO: 680 - protein, 498 aa, artificial
  BCMA-68 HL x CD3 HL bispecific molecule
EVQLLESGGGLVQPGGSLRLSCAASGFTFSNYDMAWVRQAPGKGLEWVSSISTRGDITSYRDSVKGRFTISRDNAKNTLYLQMNSLRAEDTAVYYCARQDYYTDYMGFAYWGQGTLVTVSSGGGGSGGGGSGGGGSAIQMTQSPSSLSASVGDTVTITCRASEDIYNGLAWYQQKPGKAPKLLIYGASSLQDGVPSRFSGSGSGTDYTLTISSLQPEDEATYYCQQSRNYQQTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 681 - protein, 5 aa, artificial
  VH CDR1 of BCMA-69
NYDMA

SEQ ID NO: 682 - protein, 17 aa, artificial
  VH CDR2 of BCMA-69
SISTRGDITSYRDSVKG

SEQ ID NO: 683 - protein, 12 aa, artificial
  VH CDR3 of BCMA-69
QDYYTDYMGFAY

SEQ ID NO: 684 - protein, 11 aa, artificial
  VL CDR1 of BCMA-69
RASEDIYNGLA

SEQ ID NO: 685 - protein, 7 aa, artificial
  VL CDR2 of BCMA-69
GASSLQD

SEQ ID NO: 686 - protein, 9 aa, artificial
  VL CDR3 of BCMA-69
QQSRNYQQT

SEQ ID NO: 687 - protein, 121 aa, artificial; identical to SEQ ID NO: 647
  VH of BCMA-69

SEQ ID NO: 688 - protein, 107 aa, artificial
  VL of BCMA-69
AIQMTQSPSSLSASVGDRVTITCRASEDIYNGLAWYQQKPGKAPKLLIYGASSLQDGVPSRFSGSGSGTHYTLTISSLQPEDEATYYCQQSRNYQQTFGGGTKVEIK

SEQ ID NO: 689 - protein, 243 aa, artificial
  BCMA-69 scFv
EVQLLESGGGLVQPGGSLRLSCAASGFTFSNYDMAWVRQAPGKGLEWVSSISTRGDITSYRDSVKGRFTISRDNSKNTLYLQMNSLRAEDTAVYYCARQDYYTDYMGFAYWGQGTLVTVSSGGGGSGGGGSGGGGSAIQMTQSPSSLSASVGDRVTITCRASEDIYNGLAWYQQKPGKAPKLLIYGASSLQDGVPSRFSGSGSGTHYTLTISSLQPEDEATYYCQQSRNYQQTFGGGTKVEIK

SEQ ID NO: 690 - protein, 498 aa, artificial
  BCMA-69 HL x CD3 HL bispecific molecule
EVQLLESGGGLVQPGGSLRLSCAASGFTFSNYDMAWVRQAPGKGLEWVSSISTRGDITSYRDSVKGRFTISRDNSKNTLYLQMNSLRAEDTAVYYCARQDYYTDYMGFAYWGQGTLVTVSSGGGGSGGGGSGGGGSAIQMTQSPSSLSASVGDRVTITCRASEDIYNGLAWYQQKPGKAPKLLIYGASSLQDGVPSRFSGSGSGTHYTLTISSLQPEDEATYYCQQSRNYQQTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 691 - protein, 5 aa, artificial
  VH CDR1 of BCMA-70
NYDMA

SEQ ID NO: 692 - protein, 17 aa, artificial
  VH CDR2 of BCMA-70
SISTRGDITSYRDSVKG

SEQ ID NO: 693 - protein, 12 aa, artificial
  VH CDR3 of BCMA-70
QDYYTDYMGFAY

SEQ ID NO: 694 - protein, 11 aa, artificial
  VL CDR1 of BCMA-70
RASEDIYNGLA

SEQ ID NO: 695 - protein, 7 aa, artificial
  VL CDR2 of BCMA-70
GASSLQD

SEQ ID NO: 696 - protein, 9 aa, artificial
  VL CDR3 of BCMA-70
QQSRNYQQT

SEQ ID NO: 697 - protein, 121 aa, artificial; identical to SEQ ID NO: 647
  VH of BCMA-70

SEQ ID NO: 698 - protein, 107 aa, artificial
  VL of BCMA-70
AIQMTQSPSSLSASVGDRVTITCRASEDIYNGLAWYQQKPGKAPKLLIYGASSLQDGVPSRFSGSGSGTEFTLTISSLQPEDEATYYCQQSRNYQQTFGGGTKVEIK

SEQ ID NO: 699 - protein, 243 aa, artificial
  BCMA-70 of scFv
EVQLLESGGGLVQPGGSLRLSCAASGFTFSNYDMAWVRQAPGKGLEWVSSISTRGDITSYRDSVKGRFTISRDNSKNTLYLQMNSLRAEDTAVYYCARQDYYTDYMGFAYWGQGTLVTVSSGGGGSGGGGSGGGGSAIQMTQSPSSLSASVGDRVTITCRASEDIYNGLAWYQQKPGKAPKLLIYGASSLQDGVPSRFSGSGSGTEFTLTISSLQPEDEATYYCQQSRNYQQTFGGGTKVEIK

SEQ ID NO: 700 - protein, 498 aa, artificial
  BCMA-70 HL x CD3 HL bispecific molecule
EVQLLESGGGLVQPGGSLRLSCAASGFTFSNYDMAWVRQAPGKGLEWVSSISTRGDITSYRDSVKGRFTISRDNSKNTLYLQMNSLRAEDTAVYYCARQDYYTDYMGFAYWGQGTLVTVSSGGGGSGGGGSGGGGSAIQMTQSPSSLSASVGDRVTITCRASEDIYNGLAWYQQKPGKAPKLLIYGASSLQDGVPSRFSGSGSGTEFTLTISSLQPEDEATYYCQQSRNYQQTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 701 - protein, 5 aa, artificial
  VH CDR1 of BCMA-71
NYDMA

SEQ ID NO: 702 - protein, 17 aa, artificial
  VH CDR2 of BCMA-71
SISTRGDITSYRDSVKG

SEQ ID NO: 703 - protein, 12 aa, artificial
  VH CDR3 of BCMA-71
QDYYTDYMGFAY

SEQ ID NO: 704 - protein, 11 aa, artificial
  VL CDR1 of BCMA-71
RASEDIYNGLA

SEQ ID NO: 705 - protein, 7 aa, artificial
  VL CDR2 of BCMA-71
GASSLQD

SEQ ID NO: 706 - protein, 9 aa, artificial
  VL CDR3 of BCMA-71
AGPHKYPLT

SEQ ID NO: 707 - protein, 121 aa, artificial; identical to SEQ ID NO: 647
  VH of BCMA-71

SEQ ID NO: 708 - protein, 107 aa, artificial
  VL of BCMA-71
AIQMTQSPSSLSASVGDRVTITCRASEDIYNGLAWYQQKPGKAPKLLIYGASSLQDGVPSRFSGSGSGTEFTLTISSLQPEDEATYYCAGPHKYPLTFGGGTKVEIK

SEQ ID NO: 709 - protein, 243 aa, artificial
  BCMA-71 scFv
EVQLLESGGGLVQPGGSLRLSCAASGFTFSNYDMAWVRQAPGKGLEWVSSISTRGDITSYRDSVKGRFTISRDNSKNTLYLQMNSLRAEDTAVYYCARQDYYTDYMGFAYWGQGTLVTVSSGGGGSGGGGSGGGGSAIQMTQSPSSLSASVGDRVTITCRASEDIYNGLAWYQQKPGKAPKLLIYGASSLQDGVPSRFSGSGSGTEFTLTISSLQPEDEATYYCAGPHKYPLTFGGGTKVEIK

SEQ ID NO: 710 - protein, 498 aa, artificial
  BCMA-71 HL x CD3 HL bispecific molecule
EVQLLESGGGLVQPGGSLRLSCAASGFTFSNYDMAWVRQAPGKGLEWVSSISTRGDITSYRDSVKGRFTISRDNSKNTLYLQMNSLRAEDTAVYYCARQDYYTDYMGFAYWGQGTLVTVSSGGGGSGGGGSGGGGSAIQMTQSPSSLSASVGDRVTITCRASEDIYNGLAWYQQKPGKAPKLLIYGASSLQDGVPSRFSGSGSGTEFTLTISSLQPEDEATYYCAGPHKYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 711 - protein, 5 aa, artificial
  VH CDR1 of BCMA-72
NYDMA

SEQ ID NO: 712 - protein, 17 aa, artificial
  VH CDR2 of BCMA-72
SISTRGDITSYRDSVKG

SEQ ID NO: 713 - protein, 12 aa, artificial
  VH CDR3 of BCMA-72
QDYYTDYMGFAY

SEQ ID NO: 714 - protein, 11 aa, artificial
  VL CDR1 of BCMA-72
RASEDIYNGLA

SEQ ID NO: 715 - protein, 7 aa, artificial
  VL CDR2 of BCMA-72
GASSLQD

SEQ ID NO: 716 - protein, 9 aa, artificial
  VL CDR3 of BCMA-72
AGPHKYPLT

SEQ ID NO: 717 - protein, 121 aa, artificial; identical to SEQ ID NO: 637
  VH of BCMA-72

SEQ ID NO: 718 - protein, 107 aa, artificial
  VL of BCMA-72
AIQMTQSPSSLSASVGDRVTITCRASEDIYNGLAWYQQKPGKAPKLLIYGASSLQDGVPSRFSGSGSGTDFTLTISSMQPEDEATYYCAGPHKYPLTFGGGTKVEIK

SEQ ID NO: 719 - protein, 243 aa, artificial
  BCMA-72 scFv
EVQLLESGGGLVQPGRSLRLSCAASGFTFSNYDMAWVRQAPGKGLEWVSSISTRGDITSYRDSVKGRFTISRDNSKNTLYLQMNSLRAEDTAVYYCARQDYYTDYMGFAYWGQGTLVTVSSGGGGSGGGGSGGGGSAIQMTQSPSSLSASVGDRVTITCRASEDIYNGLAWYQQKPGKAPKLLIYGASSLQDGVPSRFSGSGSGTDFTLTISSMQPEDEATYYCAGPHKYPLTFGGGTKVEIK

SEQ ID NO: 720 - protein, 498 aa, artificial
  BCMA-72 HL x CD3 HL bispecific molecule
EVQLLESGGGLVQPGRSLRLSCAASGFTFSNYDMAWVRQAPGKGLEWVSSISTRGDITSYRDSVKGRFTISRDNSKNTLYLQMNSLRAEDTAVYYCARQDYYTDYMGFAYWGQGTLVTVSSGGGGSGGGGSGGGGSAIQMTQSPSSLSASVGDRVTITCRASEDIYNGLAWYQQKPGKAPKLLIYGASSLQDGVPSRFSGSGSGTDFTLTISSMQPEDEATYYCAGPHKYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 721 - protein, 5 aa, artificial
  VH CDR1 of BCMA-73
NYDMA

SEQ ID NO: 722 - protein, 17 aa, artificial
  VH CDR2 of BCMA-73
SISTRGDITSYRDSVKG

SEQ ID NO: 723 - protein, 12 aa, artificial
  VH CDR3 of BCMA-73
QDYYTDYMGFAY

SEQ ID NO: 724 - protein, 11 aa, artificial
  VL CDR1 of BCMA-73
RASEDIYNGLA

SEQ ID NO: 725 - protein, 7 aa, artificial
  VL CDR2 of BCMA-73
GASSLQD

SEQ ID NO: 726 - protein, 9 aa, artificial
  VL CDR3 of BCMA-73
QQSRNYQQT

SEQ ID NO: 727 - protein, 121 aa, artificial; identical to SEQ ID NO: 637
  VH of BCMA-73

SEQ ID NO: 728 - protein, 107 aa, artificial
  VL of BCMA-73
AIQMTQSPSSLSASVGDRVTITCRASEDIYNGLAWYQQKPGKAPKLLIYGASSLQDGVPSRFSGSGSGTDFTLTISSMQPEDEATYYCQQSRNYQQTFGGGTKVEIK

SEQ ID NO: 729 - protein, 243 aa, artificial
  BCMA-73 scFv
EVQLLESGGGLVQPGRSLRLSCAASGFTFSNYDMAWVRQAPGKGLEWVSSISTRGDITSYRDSVKGRFTISRDNSKNTLYLQMNSLRAEDTAVYYCARQDYYTDYMGFAYWGQGTLVTVSSGGGGSGGGGSGGGGSAIQMTQSPSSLSASVGDRVTITCRASEDIYNGLAWYQQKPGKAPKLLIYGASSLQDGVPSRFSGSGSGTDFTLTISSMQPEDEATYYCQQSRNYQQTFGGGTKVEIK

SEQ ID NO: 730 - protein, 498 aa, artificial
  BCMA-73 HL x CD3 HL bispecific molecule
EVQLLESGGGLVQPGRSLRLSCAASGFTFSNYDMAWVRQAPGKGLEWVSSISTRGDITSYRDSVKGRFTISRDNSKNTLYLQMNSLRAEDTAVYYCARQDYYTDYMGFAYWGQGTLVTVSSGGGGSGGGGSGGGGSAIQMTQSPSSLSASVGDRVTITCRASEDIYNGLAWYQQKPGKAPKLLIYGASSLQDGVPSRFSGSGSGTDFTLTISSMQPEDEATYYCQQSRNYQQTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 731 - protein, 5 aa, artificial
  VH CDR1 of BCMA-74
NFDMA

SEQ ID NO: 732 - protein, 17 aa, artificial
  VH CDR2 of BCMA-74
SITTGGGDTYYADSVKG

SEQ ID NO: 733 - protein, 12 aa, artificial
  VH CDR3 of BCMA-74
HGYYDGYHLFDY

SEQ ID NO: 734 - protein, 11 aa, artificial
  VL CDR1 of BCMA-74
RASQGISNYLN

SEQ ID NO: 735 - protein, 7 aa, artificial
  VL CDR2 of VL CDR2
YTSNLQS

SEQ ID NO: 736 - protein, 9 aa, artificial
  VL CDR3 of BCMA-74
MGQTISSYT

SEQ ID NO: 737 - protein, 121 aa, artificial
  VH of BCMA-74
EVQLVESGGGLVQPGGSLRLSCAASGFTFSNFDMAWVRQAPGKGLVWVSSITTGGGDTYYADSVKGRFTISRDNAKNTLYLQMDSLRAEDTAVYYCVRHGYYDGYHLFDYWGQGTLVTVSS

SEQ ID NO: 738 - protein, 107 aa, artificial; identical to SEQ ID NO: 178
  VL of BCMA-74

SEQ ID NO: 739 - protein, 243 aa, artificial
  BCMA-74 scFv
EVQLVESGGGLVQPGGSLRLSCAASGFTFSNFDMAWVRQAPGKGLVWVSSITTGGGDTYYADSVKGRFTISRDNAKNTLYLQMDSLRAEDTAVYYCVRHGYYDGYHLFDYWGQGTLVTVSSGGGGSGGGGSGGGGSDIQMTQSPSSLSASVGDRVTITCRASQGISNYLNWYQQKPGKAPKPLIYYTSNLQSGVPSRFSGSGSGTDYTLTISSLQPEDFATYYCMGQTISSYTFGQGTKLEIK

SEQ ID NO: 740 - protein, 498 aa, artificial
  BCMA-74 HL x CD3 HL bispecific molecule
EVQLVESGGGLVQPGGSLRLSCAASGFTFSNFDMAWVRQAPGKGLVWVSSITTGGGDTYYADSVKGRFTISRDNAKNTLYLQMDSLRAEDTAVYYCVRHGYYDGYHLFDYWGQGTLVTVSSGGGGSGGGGSGGGGSDIQMTQSPSSLSASVGDRVTITCRASQGISNYLNWYQQKPGKAPKPLIYYTSNLQSGVPSRFSGSGSGTDYTLTISSLQPEDFATYYCMGQTISSYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 741 - protein, 5 aa, artificial
  VH CDR1 of BCMA-75
NFDMA

SEQ ID NO: 742 - protein, 17 aa, artificial
  VH CDR2 of BCMA-75
SITTGGGDTYYADSVKG

SEQ ID NO: 743 - protein, 12 aa, artificial
  VH CDR3 of BCMA-75
HGYYDGYHLFDY

SEQ ID NO: 744 - protein, 11 aa, artificial
  VL CDR1 of BCMA-75
RASQGISNYLN

SEQ ID NO: 745 - protein, 7 aa, artificial
  VL CDR2 of BCMA-75
YTSNLQS

SEQ ID NO: 746 - protein, 9 aa, artificial
  VL CDR3 of BCMA-75
MGQTISSYT

SEQ ID NO: 747 - protein, 121 aa, artificial
  VH of BCMA-75
EVQLVESGGGLVQPGGSLRLSCAASGFTFSNFDMAWVRQAPGKGLVWVSSITTGGGDTYYADSVKGRFTISRDNAKNTLYLQMNSLRAEDTAVYYCVRHGYYDGYHLFDYWGQGTLVTVSS

SEQ ID NO: 748 - protein, 107 aa, artificial; identical to SEQ ID NO: 178
  VL of BCMA-75

SEQ ID NO: 749 - protein, 243 aa, artificial
  BCMA-75 scFv
EVQLVESGGGLVQPGGSLRLSCAASGFTFSNFDMAWVRQAPGKGLVWVSSITTGGGDTYYADSVKGRFTISRDNAKNTLYLQMNSLRAEDTAVYYCVRHGYYDGYHLFDYWGQGTLVTVSSGGGGSGGGGSGGGGSDIQMTQSPSSLSASVGDRVTITCRASQGISNYLNWYQQKPGKAPKPLIYYTSNLQSGVPSRFSGSGSGTDYTLTISSLQPEDFATYYCMGQTISSYTFGQGTKLEIK

SEQ ID NO: 750 - protein, 498 aa, artificial
  BCMA-75 HL x CD3 HL bispecific molecule
EVQLVESGGGLVQPGGSLRLSCAASGFTFSNFDMAWVRQAPGKGLVWVSSITTGGGDTYYADSVKGRFTISRDNAKNTLYLQMNSLRAEDTAVYYCVRHGYYDGYHLFDYWGQGTLVTVSSGGGGSGGGGSGGGGSDIQMTQSPSSLSASVGDRVTITCRASQGISNYLNWYQQKPGKAPKPLIYYTSNLQSGVPSRFSGSGSGTDYTLTISSLQPEDFATYYCMGQTISSYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 751 - protein, 5 aa, artificial
  VH CDR1 of BCMA-76
NFDMA

SEQ ID NO: 752 - protein, 17 aa, artificial
  VH CDR2 of BCMA-76
SITTGGGDTYYADSVKG

SEQ ID NO: 753 - protein, 12 aa, artificial
  VH CDR3 of BCMA-76
HGYYDGYHLFDY

SEQ ID NO: 754 - protein, 11 aa, artificial
  VL CDR1 of BCMA-76
RASQGISNYLN

SEQ ID NO: 755 - protein, 7 aa, artificial
  VL CDR2 of BCMA-76
YTSNLQS

SEQ ID NO: 756 - protein, 9 aa, artificial
  VL CDR3 of BCMA-76
MGQTISSYT

SEQ ID NO: 757 - protein, 121 aa, artificial
  VH of BCMA-76
EVQLVESGGGLVQPGGSLRLSCAASGFTFSNFDMAWVRQAPGKGLVWVSSITTGGGDTYYADSVKGRFTISRDNAKNTLYLQMDSLRSEDTAVYYCVRHGYYDGYHLFDYWGQGTLVTVSS

SEQ ID NO: 758 - protein, 107 aa, artificial; identical to SEQ ID NO: 218
  VL of BCMA-76

SEQ ID NO: 759 - protein, 243 aa, artificial
  BCMA-76 scFv
EVQLVESGGGLVQPGGSLRLSCAASGFTFSNFDMAWVRQAPGKGLVWVSSITTGGGDTYYADSVKGRFTISRDNAKNTLYLQMDSLRSEDTAVYYCVRHGYYDGYHLFDYWGQGTLVTVSSGGGGSGGGGSGGGGSDIQMTQSPSSLSASVGDRVTISCRASQGISNYLNWYQQKPGKAPKPLIYYTSNLQSGVPSRFSGSGSGTDYTLTISSLQPEDFATYYCMGQTISSYTFGQGTKLEIK

SEQ ID NO: 760 - protein, 498 aa, artificial
  BCMA-76 HL x CD3 HL bispecific molecule
EVQLVESGGGLVQPGGSLRLSCAASGFTFSNFDMAWVRQAPGKGLVWVSSITTGGGDTYYADSVKGRFTISRDNAKNTLYLQMDSLRSEDTAVYYCVRHGYYDGYHLFDYWGQGTLVTVSSGGGGSGGGGSGGGGSDIQMTQSPSSLSASVGDRVTISCRASQGISNYLNWYQQKPGKAPKPLIYYTSNLQSGVPSRFSGSGSGTDYTLTISSLQPEDFATYYCMGQTISSYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 761 - protein, 5 aa, artificial
  VH CDR1 of BCMA-77
NFDMA

SEQ ID NO: 762 - protein, 17 aa, artificial
  VH CDR2 of VH CDR2
SITTGGGDTYYADSVKG

SEQ ID NO: 763 - protein, 12 aa, artificial
  VH CDR3 of BCMA-77
HGYYDGYHLFDY

SEQ ID NO: 764 - protein, 11 aa, artificial
  VL CDR1 of BCMA-77
RASQGISNYLN

SEQ ID NO: 765 - protein, 7 aa, artificial
  VL CDR2 of BCMA-77
YTSNLQS

SEQ ID NO: 766 - protein, 9 aa, artificial
  VL CDR3 of BCMA-77
MGQTISSYT

SEQ ID NO: 767 - protein, 121 aa, artificial
  VH of BCMA-77
EVQLVESGGGLVQPGRSLRLSCAASGFTFSNFDMAWVRQAPAKGLEWVSSITTGGGDTYYADSVKGRFTISRDNAKNTLYLQMNSLRAEDTAVYYCVRHGYYDGYHLFDYWGQGTLVTVSS

SEQ ID NO: 768 - protein, 107 aa, artificial; identical to SEQ ID NO: 228
  VL of BCMA-77

SEQ ID NO: 769 - protein, 243 aa, artificial
  BCMA-77 scFv
EVQLVESGGGLVQPGRSLRLSCAASGFTFSNFDMAWVRQAPAKGLEWVSSITTGGGDTYYADSVKGRFTISRDNAKNTLYLQMNSLRAEDTAVYYCVRHGYYDGYHLFDYWGQGTLVTVSSGGGGSGGGGSGGGGSDIQMTQSPSSLSASVGDRVTITCRASQGISNYLNWYQQKPGKAPKPLIYYTSNLQSGVPSRFSGSGSGTDFTLTISSLQPEDFATYYCMGQTISSYTFGQGTKLEIK

SEQ ID NO: 770 - protein, 498 aa, artificial
  BCMA-77 HL x CD3 HL bispecific molecule
EVQLVESGGGLVQPGRSLRLSCAASGFTFSNFDMAWVRQAPAKGLEWVSSITTGGGDTYYADSVKGRFTISRDNAKNTLYLQMNSLRAEDTAVYYCVRHGYYDGYHLFDYWGQGTLVTVSSGGGGSGGGGSGGGGSDIQMTQSPSSLSASVGDRVTITCRASQGISNYLNWYQQKPGKAPKPLIYYTSNLQSGVPSRFSGSGSGTDFTLTISSLQPEDFATYYCMGQTISSYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 771 - protein, 5 aa, artificial
  VH CDR1 of BCMA-78
NFDMA

SEQ ID NO: 772 - protein, 17 aa, artificial
  VH CDR2 of BCMA-78
SITTGGGDTYYADSVKG

SEQ ID NO: 773 - protein, 12 aa, artificial
  VH CDR3 of BCMA-78
HGYYDGYHLFDY

SEQ ID NO: 774 - protein, 11 aa, artificial
  VL CDR1 of BCMA-78
RASQGISNHLN

SEQ ID NO: 775 - protein, 7 aa, artificial
  VL CDR2 of BCMA-78
YTSNLQS

SEQ ID NO: 776 - protein, 9 aa, artificial
  VL CDR3 of BCMA-78
QQYFDRPYT

SEQ ID NO: 777 - protein, 121 aa, artificial; identical to SEQ ID NO: 747
  VH of BCMA-78

SEQ ID NO: 778 - protein, 107 aa, artificial
  VL of BCMA-78
DIQMTQSPSSLSASVGDRVTISCRASQGISNHLNWFQQKPGRAPKPLIYYTSNLQSGVPSRFSGSGSGTDFTLTISSLQPEDFATYYCQQYFDRPYTFGGGTKVEIK

SEQ ID NO: 779 - protein, 243 aa, artificial
  BCMA-78 scFv
EVQLVESGGGLVQPGGSLRLSCAASGFTFSNFDMAWVRQAPGKGLVWVSSITTGGGDTYYADSVKGRFTISRDNAKNTLYLQMNSLRAEDTAVYYCVRHGYYDGYHLFDYWGQGTLVTVSSGGGGSGGGGSGGGGSDIQMTQSPSSLSASVGDRVTISCRASQGISNHLNWFQQKPGRAPKPLIYYTSNLQSGVPSRFSGSGSGTDFTLTISSLQPEDFATYYCQQYFDRPYTFGGGTKVEIK

SEQ ID NO: 780 - protein, 498 aa, artificial
  BCMA-78 HL x CD3 HL bispecific molecule
EVQLVESGGGLVQPGGSLRLSCAASGFTFSNFDMAWVRQAPGKGLVWVSSITTGGGDTYYADSVKGRFTISRDNAKNTLYLQMNSLRAEDTAVYYCVRHGYYDGYHLFDYWGQGTLVTVSSGGGGSGGGGSGGGGSDIQMTQSPSSLSASVGDRVTISCRASQGISNHLNWFQQKPGRAPKPLIYYTSNLQSGVPSRFSGSGSGTDFTLTISSLQPEDFATYYCQQYFDRPYTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 781 - protein, 5 aa, artificial
  VH CDR1 of BCMA-79
NFDMA

SEQ ID NO: 782 - protein, 17 aa, artificial
  VH CDR2 of BCMA-79
SITTGGGDTYYADSVKG

SEQ ID NO: 783 - protein, 12 aa, artificial
  VH CDR3 of BCMA-79
HGYYDGYHLFDY

SEQ ID NO: 784 - protein, 11 aa, artificial
  VL CDR1 of BCMA-79
RASQGISNHLN

SEQ ID NO: 785 - protein, 7 aa, artificial
  VL CDR2 of BCMA-79
YTSNLQS

SEQ ID NO: 786 - protein, 9 aa, artificial
  VL CDR3 of BCMA-79
QQYFDRPYT

SEQ ID NO: 787 - protein, 121 aa, artificial; identical to SEQ ID NO: 737
  VH of BCMA-79

SEQ ID NO: 788 - protein, 107 aa, artificial
  VL of BCMA-79
DIQMTQSPSSLSASVGDRVTISCRASQGISNHLNWYQQKPGKAPKPLIYYTSNLQSGVPSRFSGSGSGTDYTLTISSLQPEDFATYYCQQYFDRPYTFGGGTKVEIK

SEQ ID NO: 789 - protein, 243 aa, artificial
  BCMA-79 scFv
EVQLVESGGGLVQPGGSLRLSCAASGFTFSNFDMAWVRQAPGKGLVWVSSITTGGGDTYYADSVKGRFTISRDNAKNTLYLQMDSLRAEDTAVYYCVRHGYYDGYHLFDYWGQGTLVTVSSGGGGSGGGGSGGGGSDIQMTQSPSSLSASVGDRVTISCRASQGISNHLNWYQQKPGKAPKPLIYYTSNLQSGVPSRFSGSGSGTDYTLTISSLQPEDFATYYCQQYFDRPYTFGGGTKVEIK

SEQ ID NO: 790 - protein, 498 aa, artificial
  BCMA-79 HL x CD3 HL bispecific molecule
EVQLVESGGGLVQPGGSLRLSCAASGFTFSNFDMAWVRQAPGKGLVWVSSITTGGGDTYYADSVKGRFTISRDNAKNTLYLQMDSLRAEDTAVYYCVRHGYYDGYHLFDYWGQGTLVTVSSGGGGSGGGGSGGGGSDIQMTQSPSSLSASVGDRVTISCRASQGISNHLNWYQQKPGKAPKPLIYYTSNLQSGVPSRFSGSGSGTDYTLTISSLQPEDFATYYCQQYFDRPYTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 791 - protein, 5 aa, artificial
  VH CDR1 of BCMA-80
NFDMA

SEQ ID NO: 792 - protein, 17 aa, artificial
  VH CDR2 of BCMA-80
SITTGGGDTYYADSVKG

SEQ ID NO: 793 - protein, 12 aa, artificial
  VH CDR3 of BCMA-80
HGYYDGYHLFDY

SEQ ID NO: 794 - protein, 11 aa, artificial
  VL CDR1 of BCMA-80
RASQGISNHLN

SEQ ID NO: 795 - protein, 7 aa, artificial
  VL CDR2 of BCMA-80
YTSNLQS

SEQ ID NO: 796 - protein, 9 aa, artificial
  VL CDR3 of BCMA-80
QQYFDRPYT

SEQ ID NO: 797 - protein, 121 aa, artificial; identical to SEQ ID NO: 737
  VH of BCMA-80

SEQ ID NO: 798 - protein, 107 aa, artificial
  VL of BCMA-80
DIQMTQSPSSLSASVGDRVTITCRASQGISNHLNWFQQKPGKAPKPLIYYTSNLQSGVPSRFSGSGSGTDFTLTISSLQPEDFATYYCQQYFDRPYTFGGGTKVEIK

SEQ ID NO: 799 - protein, 243 aa, artificial
  BCMA-80 scFv
EVQLVESGGGLVQPGGSLRLSCAASGFTFSNFDMAWVRQAPGKGLVWVSSITTGGGDTYYADSVKGRFTISRDNAKNTLYLQMDSLRAEDTAVYYCVRHGYYDGYHLFDYWGQGTLVTVSSGGGGSGGGGSGGGGSDIQMTQSPSSLSASVGDRVTITCRASQGISNHLNWFQQKPGKAPKPLIYYTSNLQSGVPSRFSGSGSGTDFTLTISSLQPEDFATYYCQQYFDRPYTFGGGTKVEIK

SEQ ID NO: 800 - protein, 498 aa, artificial
  BCMA-80 HL x CD3 HL bispecific molecule
EVQLVESGGGLVQPGGSLRLSCAASGFTFSNFDMAWVRQAPGKGLVWVSSITTGGGDTYYADSVKGRFTISRDNAKNTLYLQMDSLRAEDTAVYYCVRHGYYDGYHLFDYWGQGTLVTVSSGGGGSGGGGSGGGGSDIQMTQSPSSLSASVGDRVTITCRASQGISNHLNWFQQKPGKAPKPLIYYTSNLQSGVPSRFSGSGSGTDFTLTISSLQPEDFATYYCQQYFDRPYTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 801 - protein, 5 aa, artificial
  VH CDR1 of BCMA-81
NFDMA

SEQ ID NO: 802 - protein, 17 aa, artificial
  VH CDR2 of BCMA-81
SITTGGGDTYYADSVKG

SEQ ID NO: 803 - protein, 12 aa, artificial
  VH CDR3 of BCMA-81
HGYYDGYHLFDY

SEQ ID NO: 804 - protein, 11 aa, artificial
  VL CDR1 of BCMA-81
RASQGISNHLN

SEQ ID NO: 805 - protein, 7 aa, artificial
  VL CDR2 of BCMA-81
YTSNLQS

SEQ ID NO: 806 - protein, 9 aa, artificial
  VL CDR3 of BCMA-81
QQYFDRPYT

SEQ ID NO: 807 - protein, 121 aa, artificial; identical to SEQ ID NO: 767
  VH of BCMA-81

SEQ ID NO: 808 - protein, 107 aa, artificial
  VL of BCMA-81
DIQMTQSPSSLSASVGERVTITCRASQGISNHLNWYQQKPGKAPKSLIYYTSNLQSGVPSRFSGSGSGTDFTLTISSLQPEDFATYYCQQYFDRPYTFGGGTKVEIK

SEQ ID NO: 809 - protein, 243 aa, artificial
  BCMA-81 scFv
EVQLVESGGGLVQPGRSLRLSCAASGFTFSNFDMAWVRQAPAKGLEWVSSITTGGGDTYYADSVKGRFTISRDNAKNTLYLQMNSLRAEDTAVYYCVRHGYYDGYHLFDYWGQGTLVTVSSGGGGSGGGGSGGGGSDIQMTQSPSSLSASVGERVTITCRASQGISNHLNWYQQKPGKAPKSLIYYTSNLQSGVPSRFSGSGSGTDFTLTISSLQPEDFATYYCQQYFDRPYTFGGGTKVEIK

SEQ ID NO: 810 - protein, 498 aa, artificial
  BCMA-81 HL x CD3 HL bispecific molecule
EVQLVESGGGLVQPGRSLRLSCAASGFTFSNFDMAWVRQAPAKGLEWVSSITTGGGDTYYADSVKGRFTISRDNAKNTLYLQMNSLRAEDTAVYYCVRHGYYDGYHLFDYWGQGTLVTVSSGGGGSGGGGSGGGGSDIQMTQSPSSLSASVGERVTITCRASQGISNHLNWYQQKPGKAPKSLIYYTSNLQSGVPSRFSGSGSGTDFTLTISSLQPEDFATYYCQQYFDRPYTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 811 - protein, 5 aa, artificial
  VH CDR1 of BCMA-82
NFDMA

SEQ ID NO: 812 - protein, 17 aa, artificial
  VH CDR2 of BCMA-82
SITTGGGDTYYADSVKG

SEQ ID NO: 813 - protein, 12 aa, artificial
  VH CDR3 of BCMA-82
HGYYDGYHLFDY

SEQ ID NO: 814 - protein, 11 aa, artificial
  VL CDR1 of BCMA-82
RASQGISNHLN

SEQ ID NO: 815 - protein, 7 aa, artificial
  VL CDR2 of BCMA-82
YTSNLQS

SEQ ID NO: 816 - protein, 9 aa, artificial
  VL CDR3 of BCMA-82
QQYSNLPYT

SEQ ID NO: 817 - protein, 121 aa, artificial; identical to SEQ ID NO: 747
  VH of BCMA-82

SEQ ID NO: 818 - protein, 107 aa, artificial
  VL of BCMA-82
DIQMTQSPSSLSASVGDRVTISCRASQGISNHLNWFQQKPGRAPKPLIYYTSNLQSGVPSRFSGSGSGTDFTLTISSLQPEDFATYYCQQYSNLPYTFGGGTKVEIK

SEQ ID NO: 819 - protein, 243 aa, artificial
  BCMA-82 scFv
EVQLVESGGGLVQPGGSLRLSCAASGFTFSNFDMAWVRQAPGKGLVWVSSITTGGGDTYYADSVKGRFTISRDNAKNTLYLQMNSLRAEDTAVYYCVRHGYYDGYHLFDYWGQGTLVTVSSGGGGSGGGGSGGGGSDIQMTQSPSSLSASVGDRVTISCRASQGISNHLNWFQQKPGRAPKPLIYYTSNLQSGVPSRFSGSGSGTDFTLTISSLQPEDFATYYCQQYSNLPYTFGGGTKVEIK

SEQ ID NO: 820 - protein, 498 aa, artificial
  BCMA-82 HL x CD3 HL bispecific molecule
EVQLVESGGGLVQPGGSLRLSCAASGFTFSNFDMAWVRQAPGKGLVWVSSITTGGGDTYYADSVKGRFTISRDNAKNTLYLQMNSLRAEDTAVYYCVRHGYYDGYHLFDYWGQGTLVTVSSGGGGSGGGGSGGGGSDIQMTQSPSSLSASVGDRVTISCRASQGISNHLNWFQQKPGRAPKPLIYYTSNLQSGVPSRFSGSGSGTDFTLTISSLQPEDFATYYCQQYSNLPYTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 821 - protein, 5 aa, artificial
  VH CDR1 of BCMA-83
NFDMA

SEQ ID NO: 822 - protein, 17 aa, artificial
  VH CDR2 of BCMA-83
SITTGGGDTYYADSVKG

SEQ ID NO: 823 - protein, 12 aa, artificial
  VH CDR3 of BCMA-83
HGYYDGYHLFDY

SEQ ID NO: 824 - protein, 11 aa, artificial
  VL CDR1 of BCMA-83
RASQGISNHLN

SEQ ID NO: 825 - protein, 7 aa, artificial
  VL CDR2 of BCMA-83
YTSNLQS

SEQ ID NO: 826 - protein, 9 aa, artificial
  VL CDR3 of BCMA-83
QQYSNLPYT

SEQ ID NO: 827 - protein, 121 aa, artificial; identical to SEQ ID NO: 737
  VH of BCMA-83

SEQ ID NO: 828 - protein, 107 aa, artificial
  VL of BCMA-83
DIQMTQSPSSLSASVGDRVTISCRASQGISNHLNWYQQKPGKAPKPLIYYTSNLQSGVPSRFSGSGSGTDYTLTISSLQPEDFATYYCQQYSNLPYTFGGGTKVEIK

SEQ ID NO: 829 - protein, 243 aa, artificial
  BCMA-83 scFv
EVQLVESGGGLVQPGGSLRLSCAASGFTFSNFDMAWVRQAPGKGLVWVSSITTGGGDTYYADSVKGRFTISRDNAKNTLYLQMDSLRAEDTAVYYCVRHGYYDGYHLFDYWGQGTLVTVSSGGGGSGGGGSGGGGSDIQMTQSPSSLSASVGDRVTISCRASQGISNHLNWYQQKPGKAPKPLIYYTSNLQSGVPSRFSGSGSGTDYTLTISSLQPEDFATYYCQQYSNLPYTFGGGTKVEIK

SEQ ID NO: 830 - protein, 498 aa, artificial
  BCMA-83 HL x CD3 HL bispecific molecule
EVQLVESGGGLVQPGGSLRLSCAASGFTFSNFDMAWVRQAPGKGLVWVSSITTGGGDTYYADSVKGRFTISRDNAKNTLYLQMDSLRAEDTAVYYCVRHGYYDGYHLFDYWGQGTLVTVSSGGGGSGGGGSGGGGSDIQMTQSPSSLSASVGDRVTISCRASQGISNHLNWYQQKPGKAPKPLIYYTSNLQSGVPSRFSGSGSGTDYTLTISSLQPEDFATYYCQQYSNLPYTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 831 - protein, 5 aa, artificial
  VH CDR1 of BCMA-84
NFDMA

SEQ ID NO: 832 - protein, 17 aa, artificial
  VH CDR2 of BCMA-84
SITTGGGDTYYADSVKG

SEQ ID NO: 833 - protein, 12 aa, artificial
  VH CDR3 of BCMA-84
HGYYDGYHLFDY

SEQ ID NO: 834 - protein, 11 aa, artificial
  VL CDR1 of BCMA-84
RASQGISNHLN

SEQ ID NO: 835 - protein, 7 aa, artificial
  VL CDR2 of BCMA-84
YTSNLQS

SEQ ID NO: 836 - protein, 9 aa, artificial
  VL CDR3 of BCMA-84
QQYSNLPYT

SEQ ID NO: 837 - protein, 121 aa, artificial; identical to SEQ ID NO: 767
  VH of BCMA-84

SEQ ID NO: 838 - protein, 107 aa, artificial
  VL of BCMA-84
DIQMTQSPSSLSASVGERVTITCRASQGISNHLNWYQQKPGKAPKSLIYYTSNLQSGVPSRFSGSGSGTDFTLTISSLQPEDFATYYCQQYSNLPYTFGGGTKVEIK

SEQ ID NO: 839 - protein, 243 aa, artificial
  BCMA-84 scFv
EVQLVESGGGLVQPGRSLRLSCAASGFTFSNFDMAWVRQAPAKGLEWVSSITTGGGDTYYADSVKGRFTISRDNAKNTLYLQMNSLRAEDTAVYYCVRHGYYDGYHLFDYWGQGTLVTVSSGGGGSGGGGSGGGGSDIQMTQSPSSLSASVGERVTITCRASQGISNHLNWYQQKPGKAPKSLIYYTSNLQSGVPSRFSGSGSGTDFTLTISSLQPEDFATYYCQQYSNLPYTFGGGTKVEIK

SEQ ID NO: 840 - protein, 498 aa, artificial
  BCMA-84 HL x CD3 HL bispecific molecule
EVQLVESGGGLVQPGRSLRLSCAASGFTFSNFDMAWVRQAPAKGLEWVSSITTGGGDTYYADSVKGRFTISRDNAKNTLYLQMNSLRAEDTAVYYCVRHGYYDGYHLFDYWGQGTLVTVSSGGGGSGGGGSGGGGSDIQMTQSPSSLSASVGERVTITCRASQGISNHLNWYQQKPGKAPKSLIYYTSNLQSGVPSRFSGSGSGTDFTLTISSLQPEDFATYYCQQYSNLPYTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 841 - protein, 5 aa, artificial
  VH CDR1 of BCMA-85
NFGMN

SEQ ID NO: 842 - protein, 17 aa, artificial
  VH CDR2 of BCMA-85
WINTYTGESIYADDFKG

SEQ ID NO: 843 - protein, 12 aa, artificial
  VH CDR3 of BCMA-85
GGVYGGYDAMDY

SEQ ID NO: 844 - protein, 11 aa, artificial
  VL CDR1 of BCMA-85
RASQDISNYLN

SEQ ID NO: 845 - protein, 7 aa, artificial
  VL CDR2 of BCMA-85
YTSRLHS

SEQ ID NO: 846 - protein, 9 aa, artificial
  VL CDR3 of BCMA-85
QQGNTLPWT

SEQ ID NO: 847 - protein, 121 aa, artificial
  VH of BCMA-85
QVQLVQSGSELKKPGASVKVSCKASGYTFTNFGMNWVRQAPGQGLEWMGWINTYTGESIYADDFKGRFVFSLDTSVTTAYLQINSLKDEDTAVYYCARGGVYGGYDAMDYWGQGTLVTVSS

SEQ ID NO: 848 - protein, 107 aa, artificial
  VL of BCMA-85
DIQMTQSPSSLSASLGDRVTITCRASQDISNYLNWYQQKPDKAPKLLIYYTSRLHSGVPSRFSGSGSGTDYTLTISSLEPEDIATYYCQQGNTLPWTFGQGTKVEIK

SEQ ID NO: 849 - protein, 243 aa, artificial
  BCMA-85 scFv
QVQLVQSGSELKKPGASVKVSCKASGYTFTNFGMNWVRQAPGQGLEWMGWINTYTGESIYADDFKGRFVFSLDTSVTTAYLQINSLKDEDTAVYYCARGGVYGGYDAMDYWGQGTLVTVSSGGGGSGGGGSGGGGSDIQMTQSPSSLSASLGDRVTITCRASQDISNYLNWYQQKPDKAPKLLIYYTSRLHSGVPSRFSGSGSGTDYTLTISSLEPEDIATYYCQQGNTLPWTFGQGTKVEIK

SEQ ID NO: 850 - protein, 498 aa, artificial
  BCMA-85 HL x CD3 HL bispecific molecule
QVQLVQSGSELKKPGASVKVSCKASGYTFTNFGMNWVRQAPGQGLEWMGWINTYTGESIYADDFKGRFVFSLDTSVTTAYLQINSLKDEDTAVYYCARGGVYGGYDAMDYWGQGTLVTVSSGGGGSGGGGSGGGGSDIQMTQSPSSLSASLGDRVTITCRASQDISNYLNWYQQKPDKAPKLLIYYTSRLHSGVPSRFSGSGSGTDYTLTISSLEPEDIATYYCQQGNTLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 851 - protein, 5 aa, artificial
  VH CDR1 of BCMA-86
NFGMN

SEQ ID NO: 852 - protein, 17 aa, artificial
  VH CDR2 of BCMA-86
WINTYTGESIYADDFKG

SEQ ID NO: 853 - protein, 12 aa, artificial
  VH CDR3 of BCMA-86
GGVYGGYDAMDY

SEQ ID NO: 854 - protein, 11 aa, artificial
  VL CDR1 of BCMA-86
RASQDISNYLN

SEQ ID NO: 855 - protein, 7 aa, artificial
  VL CDR2 of BCMA-86
YTSRLHS

SEQ ID NO: 856 - protein, 9 aa, artificial
  VL CDR3 of BCMA-86
QQGNTLPWT

SEQ ID NO: 857 - protein, 121 aa, artificial
  VH of BCMA-86
QVQLVQSGSELKKPGASVKVSCKASGYTFTNFGMNWVRQAPGQGLEWMGWINTYTGESIYADDFKGRFVFSSDTSVSTAYLQINSLKAEDTAVYFCARGGVYGGYDAMDYWGQGTLVTVSS

SEQ ID NO: 858 - protein, 107 aa, artificial
  VL of BCMA-86
DIQMTQTPSSLSASVGDRVTITCRASQDISNYLNWYQQKPGKALKLLIYYTSRLHSGVPSRFSGSGSGTDYSLTISNLQPEDIATYYCQQGNTLPWTFGQGTKVEIK

SEQ ID NO: 859 - protein, 243 aa, artificial
  BCMA-86 scFv
QVQLVQSGSELKKPGASVKVSCKASGYTFTNFGMNWVRQAPGQGLEWMGWINTYTGESIYADDFKGRFVFSSDTSVSTAYLQINSLKAEDTAVYFCARGGVYGGYDAMDYWGQGTLVTVSSGGGGSGGGGSGGGGSDIQMTQTPSSLSASVGDRVTITCRASQDISNYLNWYQQKPGKALKLLIYYTSRLHSGVPSRFSGSGSGTDYSLTISNLQPEDIATYYCQQGNTLPWTFGQGTKVEIK

SEQ ID NO: 860 - protein, 498 aa, artificial
  BCMA-86 HL x CD3 HL bispecific molecule
QVQLVQSGSELKKPGASVKVSCKASGYTFTNFGMNWVRQAPGQGLEWMGWINTYTGESIYADDFKGRFVFSSDTSVSTAYLQINSLKAEDTAVYFCARGGVYGGYDAMDYWGQGTLVTVSSGGGGSGGGGSGGGGSDIQMTQTPSSLSASVGDRVTITCRASQDISNYLNWYQQKPGKALKLLIYYTSRLHSGVPSRFSGSGSGTDYSLTISNLQPEDIATYYCQQGNTLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 861 - protein, 5 aa, artificial
  VH CDR1 of BCMA-87
NFGMN

SEQ ID NO: 862 - protein, 17 aa, artificial
  VH CDR2 of BCMA-87
WINTYTGESIYADDFKG

SEQ ID NO: 863 - protein, 12 aa, artificial
  VH CDR3 of BCMA-87
GGVYGGYDAMDY

SEQ ID NO: 864 - protein, 11 aa, artificial
  VL CDR1 of BCMA-87
RASQDISNYLN

SEQ ID NO: 865 - protein, 7 aa, artificial
  VL CDR2 of BCMA-87
YTSRLHS

SEQ ID NO: 866 - protein, 9 aa, artificial
  VL CDR3 of BCMA-87
QQGNTLPWT

SEQ ID NO: 867 - protein, 121 aa, artificial; identical to SEQ ID NO: 847
  VH of BCMA-87

SEQ ID NO: 868 - protein, 107 aa, artificial
  VL of BCMA-87
DIQMTQSPSSLSASVGDRVTITCRASQDISNYLNWYQQKPGKAPKLLIYYTSRLHSGVPSRFSGSGSGTDYTLTISSLEQEDIATYFCQQGNTLPWTFGQGTKVEIK

SEQ ID NO: 869 - protein, 243 aa, artificial
  BCMA-87 scFv
QVQLVQSGSELKKPGASVKVSCKASGYTFTNFGMNWVRQAPGQGLEWMGWINTYTGESIYADDFKGRFVFSLDTSVTTAYLQINSLKDEDTAVYYCARGGVYGGYDAMDYWGQGTLVTVSSGGGGSGGGGSGGGGSDIQMTQSPSSLSASVGDRVTITCRASQDISNYLNWYQQKPGKAPKLLIYYTSRLHSGVPSRFSGSGSGTDYTLTISSLEQEDIATYFCQQGNTLPWTFGQGTKVEIK

SEQ ID NO: 870 - protein, 498 aa, artificial
  BCMA-87 HL x CD3 HL bispecific molecule
QVQLVQSGSELKKPGASVKVSCKASGYTFTNFGMNWVRQAPGQGLEWMGWINTYTGESIYADDFKGRFVFSLDTSVTTAYLQINSLKDEDTAVYYCARGGVYGGYDAMDYWGQGTLVTVSSGGGGSGGGGSGGGGSDIQMTQSPSSLSASVGDRVTITCRASQDISNYLNWYQQKPGKAPKLLIYYTSRLHSGVPSRFSGSGSGTDYTLTISSLEQEDIATYFCQQGNTLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 871 - protein, 5 aa, artificial
  VH CDR1 of BCMA-88
NFGMN

SEQ ID NO: 872 - protein, 17 aa, artificial
  VH CDR2 of BCMA-88
WINTYTGESIYADDFKG

SEQ ID NO: 873 - protein, 12 aa, artificial
  VH CDR3 of BCMA-88
GGVYGGYDAMDY

SEQ ID NO: 874 - protein, 11 aa, artificial
  VL CDR1 of BCMA-88
RASQDISNYLN

SEQ ID NO: 875 - protein, 7 aa, artificial
  VL CDR2 of BCMA-88
YTSRLHS

SEQ ID NO: 876 - protein, 9 aa, artificial
  VL CDR3 of BCMA-88
QSFATLPWT

SEQ ID NO: 877 - protein, 121 aa, artificial; identical to SEQ ID NO: 857
  VH of BCMA-88

SEQ ID NO: 878 - protein, 107 aa, artificial
  VL of BCMA-88
DIQMTQTPSSLSASVGDRVTITCRASQDISNYLNWYQQKPGKALKLLIYYTSRLHSGVPSRFSGSGSGTDYSLTISNLQPEDIATYYCQSFATLPWTFGQGTKVEIK

SEQ ID NO: 879 - protein, 243 aa, artificial
  BCMA-88 scFv
QVQLVQSGSELKKPGASVKVSCKASGYTFTNFGMNWVRQAPGQGLEWMGWINTYTGESIYADDFKGRFVFSSDTSVSTAYLQINSLKAEDTAVYFCARGGVYGGYDAMDYWGQGTLVTVSSGGGGSGGGGSGGGGSDIQMTQTPSSLSASVGDRVTITCRASQDISNYLNWYQQKPGKALKLLIYYTSRLHSGVPSRFSGSGSGTDYSLTISNLQPEDIATYYCQSFATLPWTFGQGTKVEIK

SEQ ID NO: 880 - protein, 498 aa, artificial
  BCMA-88 HL x CD3 HL bispecific molecule
QVQLVQSGSELKKPGASVKVSCKASGYTFTNFGMNWVRQAPGQGLEWMGWINTYTGESIYADDFKGRFVFSSDTSVSTAYLQINSLKAEDTAVYFCARGGVYGGYDAMDYWGQGTLVTVSSGGGGSGGGGSGGGGSDIQMTQTPSSLSASVGDRVTITCRASQDISNYLNWYQQKPGKALKLLIYYTSRLHSGVPSRFSGSGSGTDYSLTISNLQPEDIATYYCQSFATLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 881 - protein, 5 aa, artificial
  VH CDR1 of BCMA-89
NFGMN

SEQ ID NO: 882 - protein, 17 aa, artificial
  VH CDR2 of BCMA-89
WINTYTGESIYADDFKG

SEQ ID NO: 883 - protein, 12 aa, artificial
  VH CDR3 of BCMA-89
GGVYGGYDAMDY

SEQ ID NO: 884 - protein, 11 aa, artificial
  VL CDR1 of BCMA-89
RASQDISNYLN

SEQ ID NO: 885 - protein, 7 aa, artificial
  VL CDR2 of BCMA-89
YTSRLHS

SEQ ID NO: 886 - protein, 9 aa, artificial
  VL CDR3 of BCMA-89
QSFATLPWT

SEQ ID NO: 887 - protein, 121 aa, artificial
  VH of BCMA-89
QVQLVQSGSELKKPGASVKISCKASGYTFTNFGMNWVRQAPGQGLEWMGWINTYTGESIYADDFKGRFVFSSDTSVSTAYLQINNLKAEDTAVYYCARGGVYGGYDAMDYWGQGTLVTVSS

SEQ ID NO: 888 - protein, 107 aa, artificial
  VL of BCMA-89
DIQMTQSPSSLSASVGDRVTISCRASQDISNYLNWYQQKPGKAPKLLIYYTSRLHSGVPSRFSGSGSGTDYTFTISNLQPEDIATYYCQSFATLPWTFGQGTKVEIK

SEQ ID NO: 889 - protein, 243 aa, artificial
  BCMA-89 scFv
QVQLVQSGSELKKPGASVKISCKASGYTFTNFGMNWVRQAPGQGLEWMGWINTYTGESIYADDFKGRFVFSSDTSVSTAYLQINNLKAEDTAVYYCARGGVYGGYDAMDYWGQGTLVTVSSGGGGSGGGGSGGGGSDIQMTQSPSSLSASVGDRVTISCRASQDISNYLNWYQQKPGKAPKLLIYYTSRLHSGVPSRFSGSGSGTDYTFTISNLQPEDIATYYCQSFATLPWTFGQGTKVEIK

SEQ ID NO: 890 - protein, 498 aa, artificial
  BCMA-89 HL x CD3 HL bispecific molecule
QVQLVQSGSELKKPGASVKISCKASGYTFTNFGMNWVRQAPGQGLEWMGWINTYTGESIYADDFKGRFVFSSDTSVSTAYLQINNLKAEDTAVYYCARGGVYGGYDAMDYWGQGTLVTVSSGGGGSGGGGSGGGGSDIQMTQSPSSLSASVGDRVTISCRASQDISNYLNWYQQKPGKAPKLLIYYTSRLHSGVPSRFSGSGSGTDYTFTISNLQPEDIATYYCQSFATLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 891 - protein, 5 aa, artificial
  VH CDR1 of BCMA-90
NFGMN

SEQ ID NO: 892 - protein, 17 aa, artificial
  VH CDR2 of BCMA-90
WINTYTGESIYADDFKG

SEQ ID NO: 893 - protein, 12 aa, artificial
  VH CDR3 of BCMA-90
GGVYGGYDAMDY

SEQ ID NO: 894 - protein, 11 aa, artificial
  VL CDR1 of BCMA-90
RASQDISNYLN

SEQ ID NO: 895 - protein, 7 aa, artificial
  VL CDR2 of BCMA-90
YTSRLHS

SEQ ID NO: 896 - protein, 9 aa, artificial
  VL CDR3 of BCMA-90
QSFATLPWT

SEQ ID NO: 897 - protein, 121 aa, artificial; identical to SEQ ID NO: 847
  VH of BCMA-90

SEQ ID NO: 898 - protein, 107 aa, artificial
  VL of BCMA-90
DIQMTQSPSSLSASLGDRVTITCRASQDISNYLNWYQQKPDKAPKLLIYYTSRLHSGVPSRFSGSGSGTDYTLTISSLEPEDIATYYCQSFATLPWTFGQGTKVEIK

SEQ ID NO: 899 - protein, 243 aa, artificial
  BCMA-90 scFv
QVQLVQSGSELKKPGASVKVSCKASGYTFTNFGMNWVRQAPGQGLEWMGWINTYTGESIYADDFKGRFVFSLDTSVTTAYLQINSLKDEDTAVYYCARGGVYGGYDAMDYWGQGTLVTVSSGGGGSGGGGSGGGGSDIQMTQSPSSLSASLGDRVTITCRASQDISNYLNWYQQKPDKAPKLLIYYTSRLHSGVPSRFSGSGSGTDYTLTISSLEPEDIATYYCQSFATLPWTFGQGTKVEIK

SEQ ID NO: 900 - protein, 498 aa, artificial
  BCMA-90 HL x CD3 HL bispecific molecule
QVQLVQSGSELKKPGASVKVSCKASGYTFTNFGMNWVRQAPGQGLEWMGWINTYTGESIYADDFKGRFVFSLDTSVTTAYLQINSLKDEDTAVYYCARGGVYGGYDAMDYWGQGTLVTVSSGGGGSGGGGSGGGGSDIQMTQSPSSLSASLGDRVTITCRASQDISNYLNWYQQKPDKAPKLLIYYTSRLHSGVPSRFSGSGSGTDYTLTISSLEPEDIATYYCQSFATLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 901 - protein, 5 aa, artificial
  VH CDR1 of BCMA-91
NFGMN

SEQ ID NO: 902 - protein, 17 aa, artificial
  VH CDR2 of BCMA-91
WINTYTGESIYADDFKG

SEQ ID NO: 903 - protein, 12 aa, artificial
  VH CDR3 of BCMA-91
GGVYGGYDAMDY

SEQ ID NO: 904 - protein, 11 aa, artificial
  VL CDR1 of BCMA-91
RASQDISNYLN

SEQ ID NO: 905 - protein, 7 aa, artificial
  VL CDR2 of BCMA-91
YTSRLHS

SEQ ID NO: 906 - protein, 9 aa, artificial
  VL CDR3 of BCMA-91
QSFATLPWT

SEQ ID NO: 907 - protein, 121 aa, artificial; identical to SEQ ID NO: 847
  VH of BCMA-91

SEQ ID NO: 908 - protein, 107 aa, artificial
  VL of BCMA-91
DIQMTQSPSSLSASVGDRVTITCRASQDISNYLNWYQQKPGKAPKLLIYYTSRLHSGVPSRFSGSGSGTDYTLTISSLEQEDIATYFCQSFATLPWTFGQGTKVEIK

SEQ ID NO: 909 - protein, 243 aa, artificial
  BCMA-91 scFv
QVQLVQSGSELKKPGASVKVSCKASGYTFTNFGMNWVRQAPGQGLEWMGWINTYTGESIYADDFKGRFVFSLDTSVTTAYLQINSLKDEDTAVYYCARGGVYGGYDAMDYWGQGTLVTVSSGGGGSGGGGSGGGGSDIQMTQSPSSLSASVGDRVTITCRASQDISNYLNWYQQKPGKAPKLLIYYTSRLHSGVPSRFSGSGSGTDYTLTISSLEQEDIATYFCQSFATLPWTFGQGTKVEIK

SEQ ID NO: 910 - protein, 498 aa, artificial
  BCMA-91 HL x CD3 HL bispecific molecule
QVQLVQSGSELKKPGASVKVSCKASGYTFTNFGMNWVRQAPGQGLEWMGWINTYTGESIYADDFKGRFVFSLDTSVTTAYLQINSLKDEDTAVYYCARGGVYGGYDAMDYWGQGTLVTVSSGGGGSGGGGSGGGGSDIQMTQSPSSLSASVGDRVTITCRASQDISNYLNWYQQKPGKAPKLLIYYTSRLHSGVPSRFSGSGSGTDYTLTISSLEQEDIATYFCQSFATLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 911 - protein, 5 aa, artificial
  VH CDR1 of BCMA-92
NFGMN

SEQ ID NO: 912 - protein, 17 aa, artificial
  VH CDR2 of BCMA-92
WINTYTGESIYADDFKG

SEQ ID NO: 913 - protein, 12 aa, artificial
  VH CDR3 of BCMA-92
GGVYGGYDAMDY

SEQ ID NO: 914 - protein, 11 aa, artificial
  VL CDR1 of BCMA-92
RASQDISNYLN

SEQ ID NO: 915 - protein, 7 aa, artificial
  VL CDR2 of BCMA-92
YTSRLHS

SEQ ID NO: 916 - protein, 9 aa, artificial
  VL CDR3 of BCMA-92
QHFRTLPWT

SEQ ID NO: 917 - protein, 121 aa, artificial; identical to SEQ ID NO: 847
  VH of BCMA-92

SEQ ID NO: 918 - protein, 107 aa, artificial
  VL of BCMA-92
DIQMTQSPSSLSASLGDRVTITCRASQDISNYLNWYQQKPDKAPKLLIYYTSRLHSGVPSRFSGSGSGTDYTLTISSLEPEDIATYYCQHFRTLPWTFGQGTKVEIK

SEQ ID NO: 919 - protein, 243 aa, artificial
  BCMA-92 scFv
QVQLVQSGSELKKPGASVKVSCKASGYTFTNFGMNWVRQAPGQGLEWMGWINTYTGESIYADDFKGRFVFSLDTSVTTAYLQINSLKDEDTAVYYCARGGVYGGYDAMDYWGQGTLVTVSSGGGGSGGGGSGGGGSDIQMTQSPSSLSASLGDRVTITCRASQDISNYLNWYQQKPDKAPKLLIYYTSRLHSGVPSRFSGSGSGTDYTLTISSLEPEDIATYYCQHFRTLPWTFGQGTKVEIK

SEQ ID NO: 920 - protein, 498 aa, artificial
  BCMA-92 HL x CD3 HL bispecific molecule
QVQLVQSGSELKKPGASVKVSCKASGYTFTNFGMNWVRQAPGQGLEWMGWINTYTGESIYADDFKGRFVFSLDTSVTTAYLQINSLKDEDTAVYYCARGGVYGGYDAMDYWGQGTLVTVSSGGGGSGGGGSGGGGSDIQMTQSPSSLSASLGDRVTITCRASQDISNYLNWYQQKPDKAPKLLIYYTSRLHSGVPSRFSGSGSGTDYTLTISSLEPEDIATYYCQHFRTLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 921 - protein, 5 aa, artificial
  VH CDR1 of BCMA-93
NFGMN

SEQ ID NO: 922 - protein, 17 aa, artificial
  VH CDR2 of BCMA-93
WINTYTGESIYADDFKG

SEQ ID NO: 923 - protein, 12 aa, artificial
  VH CDR3 of BCMA-93
GGVYGGYDAMDY

SEQ ID NO: 924 - protein, 11 aa, artificial
  VL CDR1 of BCMA-93
RASQDISNYLN

SEQ ID NO: 925 - protein, 7 aa, artificial
  VL CDR2 of BCMA-93
YTSRLHS

SEQ ID NO: 926 - protein, 9 aa, artificial
  VL CDR3 of BCMA-93
QHFRTLPWT

SEQ ID NO: 927 - protein, 121 aa, artificial; identical to SEQ ID NO: 857
  VH of BCMA-93

SEQ ID NO: 928 - protein, 107 aa, artificial
  VL of BCMA-93
DIQMTQTPSSLSASVGDRVTITCRASQDISNYLNWYQQKPGKALKLLIYYTSRLHSGVPSRFSGSGSGTDYSLTISNLQPEDIATYYCQHFRTLPWTFGQGTKVEIK

SEQ ID NO: 929 - protein, 243 aa, artificial
  BCMA-93 scFv
QVQLVQSGSELKKPGASVKVSCKASGYTFTNFGMNWVRQAPGQGLEWMGWINTYTGESIYADDFKGRFVFSSDTSVSTAYLQINSLKAEDTAVYFCARGGVYGGYDAMDYWGQGTLVTVSSGGGGSGGGGSGGGGSDIQMTQTPSSLSASVGDRVTITCRASQDISNYLNWYQQKPGKALKLLIYYTSRLHSGVPSRFSGSGSGTDYSLTISNLQPEDIATYYCQHFRTLPWTFGQGTKVEIK

SEQ ID NO: 930 - protein, 498 aa, artificial
  BCMA-93 HL x CD3 HL bispecific molecule
QVQLVQSGSELKKPGASVKVSCKASGYTFTNFGMNWVRQAPGQGLEWMGWINTYTGESIYADDFKGRFVFSSDTSVSTAYLQINSLKAEDTAVYFCARGGVYGGYDAMDYWGQGTLVTVSSGGGGSGGGGSGGGGSDIQMTQTPSSLSASVGDRVTITCRASQDISNYLNWYQQKPGKALKLLIYYTSRLHSGVPSRFSGSGSGTDYSLTISNLQPEDIATYYCQHFRTLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 931 - protein, 5 aa, artificial
  VH CDR1 of BCMA-94
NFGMN

SEQ ID NO: 932 - protein, 17 aa, artificial
  VH CDR2 of BCMA-94
WINTYTGESIYADDFKG

SEQ ID NO: 933 - protein, 12 aa, artificial
  VH CDR3 of BCMA-94
GGVYGGYDAMDY

SEQ ID NO: 934 - protein, 11 aa, artificial
  VL CDR1 of BCMA-94
RASQDISNYLN

SEQ ID NO: 935 - protein, 7 aa, artificial
  VL CDR2 of BCMA-94
YTSRLHS

SEQ ID NO: 936 - protein, 9 aa, artificial
  VL CDR3 of BCMA-94
QHFRTLPWT

SEQ ID NO: 937 - protein, 121 aa, artificial; identical to SEQ ID NO: 847
  VH of BCMA-94

SEQ ID NO: 938 - protein, 107 aa, artificial
  VL of BCMA-94
DIQMTQSPSSLSASVGDRVTITCRASQDISNYLNWYQQKPGKAPKLLIYYTSRLHSGVPSRFSGSGSGTDYTLTISSLEQEDIATYFCQHFRTLPWTFGQGTKVEIK

SEQ ID NO: 939 - protein, 243 aa, artificial
  BCMA-94 scFv
QVQLVQSGSELKKPGASVKVSCKASGYTFTNFGMNWVRQAPGQGLEWMGWINTYTGESIYADDFKGRFVFSLDTSVTTAYLQINSLKDEDTAVYYCARGGVYGGYDAMDYWGQGTLVTVSSGGGGSGGGGSGGGGSDIQMTQSPSSLSASVGDRVTITCRASQDISNYLNWYQQKPGKAPKLLIYYTSRLHSGVPSRFSGSGSGTDYTLTISSLEQEDIATYFCQHFRTLPWTFGQGTKVEIK

SEQ ID NO: 940 - protein, 498 aa, artificial
  BCMA-94 HL x CD3 HL bispecific molecule
QVQLVQSGSELKKPGASVKVSCKASGYTFTNFGMNWVRQAPGQGLEWMGWINTYTGESIYADDFKGRFVFSLDTSVTTAYLQINSLKDEDTAVYYCARGGVYGGYDAMDYWGQGTLVTVSSGGGGSGGGGSGGGGSDIQMTQSPSSLSASVGDRVTITCRASQDISNYLNWYQQKPGKAPKLLIYYTSRLHSGVPSRFSGSGSGTDYTLTISSLEQEDIATYFCQHFRTLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 941 - protein, 5 aa, artificial
  VH CDR1 of BCMA-95
NFGMN

SEQ ID NO: 942 - protein, 17 aa, artificial
  VH CDR2 of BCMA-95
WINTYTGESIYADDFKG

SEQ ID NO: 943 - protein, 12 aa, artificial
  VH CDR3 of BCMA-95
GGVYGGYDAMDY

SEQ ID NO: 944 - protein, 11 aa, artificial
  VL CDR1 of BCMA-95
RASQDISNYLN

SEQ ID NO: 945 - protein, 7 aa, artificial
  VL CDR2 of BCMA-95
YTSRLHS

SEQ ID NO: 946 - protein, 9 aa, artificial
  VL CDR3 of BCMA-95
QHFRTLPWT

SEQ ID NO: 947 - protein, 121 aa, artificial; identical to SEQ ID NO: 887
  VH of BCMA-95

SEQ ID NO: 948 - protein, 107 aa, artificial
  VL of BCMA-95
DIQMTQSPSSLSASVGDRVTISCRASQDISNYLNWYQQKPGKAPKLLIYYTSRLHSGVPSRFSGSGSGTDYTFTISNLQPEDIATYFCQHFRTLPWTFGQGTKVEIK

SEQ ID NO: 949 - protein, 243 aa, artificial
  BCMA-95 scFv
QVQLVQSGSELKKPGASVKISCKASGYTFTNFGMNWVRQAPGQGLEWMGWINTYTGESIYADDFKGRFVFSSDTSVSTAYLQINNLKAEDTAVYYCARGGVYGGYDAMDYWGQGTLVTVSSGGGGSGGGGSGGGGSDIQMTQSPSSLSASVGDRVTISCRASQDISNYLNWYQQKPGKAPKLLIYYTSRLHSGVPSRFSGSGSGTDYTFTISNLQPEDIATYFCQHFRTLPWTFGQGTKVEIK

SEQ ID NO: 950 - protein, 498 aa, artificial
  BCMA-95 HL x CD3 HL bispecific molecule
QVQLVQSGSELKKPGASVKISCKASGYTFTNFGMNWVRQAPGQGLEWMGWINTYTGESIYADDFKGRFVFSSDTSVSTAYLQINNLKAEDTAVYYCARGGVYGGYDAMDYWGQGTLVTVSSGGGGSGGGGSGGGGSDIQMTQSPSSLSASVGDRVTISCRASQDISNYLNWYQQKPGKAPKLLIYYTSRLHSGVPSRFSGSGSGTDYTFTISNLQPEDIATYFCQHFRTLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 951 - protein, 5 aa, artificial
  VH CDR1 of BCMA-96
NFGMN

SEQ ID NO: 952 - protein, 17 aa, artificial
  VH CDR2 of BCMA-96
WINTYTGESIYADDFKG

SEQ ID NO: 953 - protein, 12 aa, artificial
  VH CDR3 of BCMA-96
GGVYGGYDAMDY

SEQ ID NO: 954 - protein, 11 aa, artificial
  VL CDR1 of BCMA-96
RASQDISNYLN

SEQ ID NO: 955 - protein, 7 aa, artificial
  VL CDR2 of BCMA-96
YTSRLHS

SEQ ID NO: 956 - protein, 9 aa, artificial
  VL CDR3 of BCMA-96
QQGNTLPWT

SEQ ID NO: 957 - protein, 121 aa, artificial; identical to SEQ ID NO: 887
  VH of BCMA-96

SEQ ID NO: 958 - protein, 107 aa, artificial
  VL of BCMA-96
DIQMTQSPSSLSASVGDRVTISCRASQDISNYLNWYQQKPGKAPKLLIYYTSRLHSGVPSRFSGSGSGTDYTFTISNLQPEDIATYYCQQGNTLPWTFGQGTKVEIK

SEQ ID NO: 959 - protein, 243 aa, artificial
  BCMA-96 of scFv
QVQLVQSGSELKKPGASVKISCKASGYTFTNFGMNWVRQAPGQGLEWMGWINTYTGESIYADDFKGRFVFSSDTSVSTAYLQINNLKAEDTAVYYCARGGVYGGYDAMDYWGQGTLVTVSSGGGGSGGGGSGGGGSDIQMTQSPSSLSASVGDRVTISCRASQDISNYLNWYQQKPGKAPKLLIYYTSRLHSGVPSRFSGSGSGTDYTFTISNLQPEDIATYYCQQGNTLPWTFGQGTKVEIK

SEQ ID NO: 960 - protein, 498 aa, artificial
  BCMA-96 HL x CD3 HL bispecific molecule
QVQLVQSGSELKKPGASVKISCKASGYTFTNFGMNWVRQAPGQGLEWMGWINTYTGESIYADDFKGRFVFSSDTSVSTAYLQINNLKAEDTAVYYCARGGVYGGYDAMDYWGQGTLVTVSSGGGGSGGGGSGGGGSDIQMTQSPSSLSASVGDRVTISCRASQDISNYLNWYQQKPGKAPKLLIYYTSRLHSGVPSRFSGSGSGTDYTFTISNLQPEDIATYYCQQGNTLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 961 - protein, 5 aa, artificial
  VH CDR1 of BCMA-97
NFDMA

SEQ ID NO: 962 - protein, 17 aa, artificial
  VH CDR2 of BCMA-97
SITTGGGDTYYADSVKG

SEQ ID NO: 963 - protein, 12 aa, artificial
  VH CDR3 of BCMA-97
HGYYDGYHLFDY

SEQ ID NO: 964 - protein, 11 aa, artificial
  VL CDR1 of BCMA-97
RASQGISNNLN

SEQ ID NO: 965 - protein, 7 aa, artificial
  VL CDR2 of BCMA-97
YTSNLQS

SEQ ID NO: 966 - protein, 9 aa, artificial
  VL CDR3 of BCMA-97
QQFTSLPYT

SEQ ID NO: 967 - protein, 121 aa, artificial; identical to SEQ ID NO: 747
  VH of BCMA-97

SEQ ID NO: 968 - protein, 107 aa, artificial
  VL of BCMA-97
DIQMTQSPSSMSASVGDRVTITCRASQGISNNLNWYQQKPGKAPKSLIYYTSNLQSGVPSRFSGSGSGTDYTLTISSLQPEDFATYYCQQFTSLPYTFGQGTKLEIK

SEQ ID NO: 969 - protein, 243 aa, artificial
  BCMA-97 scFv
EVQLVESGGGLVQPGGSLRLSCAASGFTFSNFDMAWVRQAPGKGLVWVSSITTGGGDTYYADSVKGRFTISRDNAKNTLYLQMNSLRAEDTAVYYCVRHGYYDGYHLFDYWGQGTLVTVSSGGGGSGGGGSGGGGSDIQMTQSPSSMSASVGDRVTITCRASQGISNNLNWYQQKPGKAPKSLIYYTSNLQSGVPSRFSGSGSGTDYTLTISSLQPEDFATYYCQQFTSLPYTFGQGTKLEIK

SEQ ID NO: 970 - protein, 498 aa, artificial
  BCMA-97 HL x CD3 HL bispecific molecule
EVQLVESGGGLVQPGGSLRLSCAASGFTFSNFDMAWVRQAPGKGLVWVSSITTGGGDTYYADSVKGRFTISRDNAKNTLYLQMNSLRAEDTAVYYCVRHGYYDGYHLFDYWGQGTLVTVSSGGGGSGGGGSGGGGSDIQMTQSPSSMSASVGDRVTITCRASQGISNNLNWYQQKPGKAPKSLIYYTSNLQSGVPSRFSGSGSGTDYTLTISSLQPEDFATYYCQQFTSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 971 - protein, 5 aa, artificial
  VH CDR1 of BCMA-98
NFDMA

SEQ ID NO: 972 - protein, 17 aa, artificial
  VH CDR2 of BCMA-98
SITTGGGDTYYADSVKG

SEQ ID NO: 973 - protein, 12 aa, artificial
  VH CDR3 of BCMA-98
HGYYDGYHLFDY

SEQ ID NO: 974 - protein, 11 aa, artificial
  VL CDR1 of BCMA-98
RANQGISNNLN

SEQ ID NO: 975 - protein, 7 aa, artificial
  VL CDR2 of BCMA-98
YTSNLQS

SEQ ID NO: 976 - protein, 9 aa, artificial
  VL CDR3 of BCMA-98
QQFTSLPYT

SEQ ID NO: 977 - protein, 121 aa, artificial
  VH of BCMA-98
EVQLVESGGGLVQPGGSLRLSCAASGFTFSNFDMAWVRQAPGKGLVWVSSITTGGGDTYYADSVKGRFTISRDNAKSTLYLQMDSLRSEDTAVYYCVRHGYYDGYHLFDYWGQGTLVTVSS

SEQ ID NO: 978 - protein, 107 aa, artificial
  VL of BCMA-98
DIQMTQSPSSLSASVGDRVTITCRANQGISNNLNWYQQKPGKAPKPLIYYTSNLQSGVPSRFSGSGSGTDYTLTISSLQPEDFATYYCQQFTSLPYTFGQGTKLEIK

SEQ ID NO: 979 - protein, 243 aa, artificial
  BCMA-98 scFv
EVQLVESGGGLVQPGGSLRLSCAASGFTFSNFDMAWVRQAPGKGLVWVSSITTGGGDTYYADSVKGRFTISRDNAKSTLYLQMDSLRSEDTAVYYCVRHGYYDGYHLFDYWGQGTLVTVSSGGGGSGGGGSGGGGSDIQMTQSPSSLSASVGDRVTITCRANQGISNNLNWYQQKPGKAPKPLIYYTSNLQSGVPSRFSGSGSGTDYTLTISSLQPEDFATYYCQQFTSLPYTFGQGTKLEIK

SEQ ID NO: 980 - protein, 498 aa, artificial
  BCMA-98 HL x CD3 HL bispecific molecule
EVQLVESGGGLVQPGGSLRLSCAASGFTFSNFDMAWVRQAPGKGLVWVSSITTGGGDTYYADSVKGRFTISRDNAKSTLYLQMDSLRSEDTAVYYCVRHGYYDGYHLFDYWGQGTLVTVSSGGGGSGGGGSGGGGSDIQMTQSPSSLSASVGDRVTITCRANQGISNNLNWYQQKPGKAPKPLIYYTSNLQSGVPSRFSGSGSGTDYTLTISSLQPEDFATYYCQQFTSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 981 - protein, 5 aa, artificial
  VH CDR1 of BCMA-99
NFDMA

SEQ ID NO: 982 - protein, 17 aa, artificial
  VH CDR2 of BCMA-99
SITTGGGDTYYADSVKG

SEQ ID NO: 983 - protein, 12 aa, artificial
  VH CDR3 of BCMA-99
HGYYDGYHLFDY

SEQ ID NO: 984 - protein, 11 aa, artificial
  VL CDR1 of BCMA-99
RASQGISNNLN

SEQ ID NO: 985 - protein, 7 aa, artificial
  VL CDR2 of BCMA-99
YTSNLQS

SEQ ID NO: 986 - protein, 9 aa, artificial
  VL CDR3 of BCMA-99
QQFTSLPYT

SEQ ID NO: 987 - protein, 121 aa, artificial; identical to SEQ ID NO: 757
  VH of BCMA-99

SEQ ID NO: 988 - protein, 107 aa, artificial; identical to SEQ ID NO: 968
  VL of BCMA-99

SEQ ID NO: 989 - protein, 243 aa, artificial
  BCMA-99 scFv
EVQLVESGGGLVQPGGSLRLSCAASGFTFSNFDMAWVRQAPGKGLVWVSSITTGGGDTYYADSVKGRFTISRDNAKNTLYLQMDSLRSEDTAVYYCVRHGYYDGYHLFDYWGQGTLVTVSSGGGGSGGGGSGGGGSDIQMTQSPSSMSASVGDRVTITCRASQGISNNLNWYQQKPGKAPKSLIYYTSNLQSGVPSRFSGSGSGTDYTLTISSLQPEDFATYYCQQFTSLPYTFGQGTKLEIK

SEQ ID NO: 990 - protein, 498 aa, artificial
  BCMA-99 HL x CD3 HL bispecific molecule
EVQLVESGGGLVQPGGSLRLSCAASGFTFSNFDMAWVRQAPGKGLVWVSSITTGGGDTYYADSVKGRFTISRDNAKNTLYLQMDSLRSEDTAVYYCVRHGYYDGYHLFDYWGQGTLVTVSSGGGGSGGGGSGGGGSDIQMTQSPSSMSASVGDRVTITCRASQGISNNLNWYQQKPGKAPKSLIYYTSNLQSGVPSRFSGSGSGTDYTLTISSLQPEDFATYYCQQFTSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 991 - protein, 5 aa, artificial
  VH CDR1 of BCMA-100
NFDMA

SEQ ID NO: 992 - protein, 17 aa, artificial
  VH CDR2 of BCMA-100
SITTGGGDTYYADSVKG

SEQ ID NO: 993 - protein, 12 aa, artificial
  VH CDR3 of BCMA-100
HGYYDGYHLFDY

SEQ ID NO: 994 - protein, 11 aa, artificial
  VL CDR1 of BCMA-100
RASQGISNNLN

SEQ ID NO: 995 - protein, 7 aa, artificial
  VL CDR2 of BCMA-100
YTSNLQS

SEQ ID NO: 996 - protein, 9 aa, artificial
  VL CDR3 of BCMA-100
QQFAHLPYT

SEQ ID NO: 997 - protein, 121 aa, artificial; identical to SEQ ID NO: 757
  VH of BCMA-100

SEQ ID NO: 998 - protein, 107 aa, artificial
  VL of BCMA-100
DIQMTQSPSSMSASVGDRVTITCRASQGISNNLNWYQQKPGKAPKSLIYYTSNLQSGVPSRFSGSGSGTDYTLTISSLQPEDFATYYCQQFAHLPYTFGQGTKLEIK

SEQ ID NO: 999 - protein, 243 aa, artificial
  BCMA-100 scFv
EVQLVESGGGLVQPGGSLRLSCAASGFTFSNFDMAWVRQAPGKGLVWVSSITTGGGDTYYADSVKGRFTISRDNAKNTLYLQMDSLRSEDTAVYYCVRHGYYDGYHLFDYWGQGTLVTVSSGGGGSGGGGSGGGGSDIQMTQSPSSMSASVGDRVTITCRASQGISNNLNWYQQKPGKAPKSLIYYTSNLQSGVPSRFSGSGSGTDYTLTISSLQPEDFATYYCQQFAHLPYTFGQGTKLEIK

SEQ ID NO: 1000 - protein, 498 aa, artificial
  BCMA-100 HL x CD3 HL bispecific molecule
EVQLVESGGGLVQPGGSLRLSCAASGFTFSNFDMAWVRQAPGKGLVWVSSITTGGGDTYYADSVKGRFTISRDNAKNTLYLQMDSLRSEDTAVYYCVRHGYYDGYHLFDYWGQGTLVTVSSGGGGSGGGGSGGGGSDIQMTQSPSSMSASVGDRVTITCRASQGISNNLNWYQQKPGKAPKSLIYYTSNLQSGVPSRFSGSGSGTDYTLTISSLQPEDFATYYCQQFAHLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1001 - DNA, 555 bp, human
  misc (1)..(555): human BCMA
atgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgattctctggacctgtttgggactgagcttaataatttctttggcagttttcgtgctaatgtttttgctaaggaagataaactctgaaccattaaaggacgagtttaaaaacacaggatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaa

SEQ ID NO: 1002 - protein, 184 aa, human
  misc (1)..(184): human BCMA
MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 1003 - DNA, 558 bp, mouse
  misc (1)..(558): mouse BCMA
atggcgcaacagtgtttccacagtgaatattttgacagtctgctgcatgcttgcaaaccgtgtcacttgcgatgttccaaccctcctgcaacctgtcagccttactgtgatccaagcgtgaccagttcagtgaaagggacgtacacggtgctctggatcttcttggggctgaccttggtcctctctttggcacttttcacaatctcattcttgctgaggaagatgaaccccgaggccctgaaggacgagcctcaaagcccaggtcagcttgacggatcggctcagctggacaaggccgacaccgagctgactaggatcagggctggtgacgacaggatctttccccgaagcctggagtatacagtggaagagtgcacctgtgaggactgtgtcaagagcaaacccaagggggattctgaccatttcttcccgcttccagccatggaggagggggcaaccattcttgtcaccacaaaaacgggtgactacggcaagtcaagtgtgccaactgctttgcaaagtgtcatggggatggagaagccaactcacactagataa

SEQ ID NO: 1004 - protein, 185 aa, mouse
  misc (1)..(185): mouse BCMA
MAQQCFHSEYFDSLLHACKPCHLRCSNPPATCQPYCDPSVTSSVKGTYTVLWIFLGLTLVLSLALFTISFLLRKMNPEALKDEPQSPGQLDGSAQLDKADTELTRIRAGDDRIFPRSLEYTVEECTCEDCVKSKPKGDSDHFFPLPAMEEGATILVTTKTGDYGKSSVPTALQSVMGMEKPTHTR

SEQ ID NO: 1005 - DNA, 552 bp, rhesus monkey
  misc (1)..(552): rhesus monkey BCMA
atgttgcagatggctcggcagtgctcccaaaatgaatattttgacagtttgttgcatgattgcaaaccttgtcaacttcgatgttctagtactcctcctctaacatgtcagcgttattgcaatgcaagtatgaccaattcagtgaaaggaatgaatgcgattctctggacctgtttgggactgagcttgataatttctttggcagttttcgtgctaacgtttttgctaaggaagatgagctctgaaccattaaaggatgagtttaaaaacacaggatcaggtctcctgggcatggctaacattgacctggaaaagggcaggactggtgatgaaattgttcttccaagaggcctggagtacacggtggaagaatgcacctgtgaagactgcatcaagaataaaccaaaggttgattctgaccattgctttccactcccagccatggaggaaggcgcaaccattctcgtcaccacgaaaacgaatgactattgcaatagcctgtcagctgctttgagtgttacggagatagagaaatcaatttctgctaggtaa

SEQ ID NO: 1006 - protein, 183 aa, rhesus monkey
  misc (1)..(183): rhesus monkey BCMA
MLQMARQCSQNEYFDSLLHDCKPCQLRCSSTPPLTCQRYCNASMTNSVKGMNAILWTCLGLSLIISLAVFVLTFLLRKMSSEPLKDEFKNTGSGLLGMANIDLEKGRTGDEIVLPRGLEYTVEECTCEDCIKNKPKVDSDHCFPLPAMEEGATILVTTKTNDYCNSLSAALSVTEIEKSISAR

SEQ ID NO: 1007 - protein, 54 aa, human
  misc (1)..(54): human BCMA
MLQMAGQCSQNEYFDSLLHACIPCQLRCSSNTPPLTCQRYCNASVTNSVKGTNA

SEQ ID NO: 1008 - protein, 49 aa, mouse
  misc (1)..(49): mouse BCMA
MAQQCFHSEYFDSLLHACKPCHLRCSNPPATCQPYCDPSVTSSVKGTYT

SEQ ID NO: 1009 - protein, 51 aa, artificial
  human/mouse BCMA chimera
MAQQCSQNEYFDSLLHACIPCQLRCSSNTPPLTCQRYCNASVTNSVKGTNA

SEQ ID NO: 1010 - protein, 54 aa, artificial
  human/mouse BCMA chimera
MLQMAGQCFHSEYFDSLLHACIPCQLRCSSNTPPLTCQRYCNASVTNSVKGTNA

SEQ ID NO: 1011 - protein, 52 aa, artificial
  human/mouse BCMA chimera
MLQMAGQCSQNEYFDSLLHACIPCHLRCSNPPATCQPYCNASVTNSVKGTNA

SEQ ID NO: 1012 - protein, 54 aa, artificial
  human/mouse BCMA chimera
MLQMAGQCSQNEYFDSLLHACIPCQLRCSSNTPPLTCQRYCDPSVTSSVKGTYT

SEQ ID NO: 1013 - protein, 54 aa, artificial; identical to SEQ ID NO: 1012
  human/mouse BCMA chimera

SEQ ID NO: 1014 - protein, 54 aa, artificial
  human/mouse BCMA chimera
MLQMAGQCSQNEYFDSLLHACIPCHLRCSSNTPPLTCQRYCNASVTNSVKGTNA

SEQ ID NO: 1015 - protein, 54 aa, artificial
  human/mouse BCMA chimera
MLQMAGQCSQNEYFDSLLHACIPCQLRCSSNTPPLTCQPYCNASVTNSVKGTNA

SEQ ID NO: 1016 - protein, 18 aa, human
  misc (1)..(18): human BCMA
CQLRCSSNTPPLTCQRYC

SEQ ID NO: 1017 - protein, 17 aa, rhesus monkey
  misc (1)..(17): rhesus monkey BCMA
CQLRCSSTPPLTCQRYC

SEQ ID NO: 1018 - protein, 7 aa, human
  misc (1)..(7): human BCMA
MLQMAGQ

SEQ ID NO: 1019 - protein, 13 aa, human
  misc (1)..(13): human BCMA
NASVTNSVKGTNA

SEQ ID NO: 1020 - protein, 7 aa, rhesus monkey
  misc (1)..(7): rhesus monkey BCMA
MLQMARQ

SEQ ID NO: 1021 - protein, 13 aa, rhesus monkey
  misc (1)..(13): rhesus monkey BCMA
NASMTNSVKGMNA

SEQ ID NO: 1022 - protein, 10 aa, artificial
  VH CDR1 of BCMA-101
GFTFSNYDMA

SEQ ID NO: 1023 - protein, 17 aa, artificial
  VH CDR2 of BCMA-101
SIITSGGDNYYRDSVKG

SEQ ID NO: 1024 - protein, 12 aa, artificial
  VH CDR3 of BCMA-101
HDYYDGSYGFAY

SEQ ID NO: 1025 - protein, 11 aa, artificial
  VL CDR1 of BCMA-101
KASQSVGINVD

SEQ ID NO: 1026 - protein, 7 aa, artificial
  VL CDR2 of BCMA-101
GASNRHT

SEQ ID NO: 1027 - protein, 9 aa, artificial
  VL CDR3 of BCMA-101
LQYGSIPFT

SEQ ID NO: 1028 - protein, 121 aa, artificial
  VH of BCMA-101
EVQLVESGGGLVQPGRSLKLSCAASGFTFSNYDMAWVRQAPTKGLEWVASIITSGGDNYYRDSVKGRFTVSRDNAKSTLYLQMDSLRSEDTATYYCVRHDYYDGSYGFAYWGQGTLVTVSS

SEQ ID NO: 1029 - protein, 107 aa, artificial
  VL of BCMA-101
ETVMTQSPTSMSTSIGERVTLNCKASQSVGINVDWYQQTPGQSPKLLIYGASNRHTGVPDRFTGSGFGRDFTLTISNVEAEDLAVYYCLQYGSIPFTFGSGTKLELK

SEQ ID NO: 1030 - protein, 244 aa, artificial
  BCMA-101 scFv
EVQLVESGGGLVQPGRSLKLSCAASGFTFSNYDMAWVRQAPTKGLEWVASIITSGGDNYYRDSVKGRFTVSRDNAKSTLYLQMDSLRSEDTATYYCVRHDYYDGSYGFAYWGQGTLVTVSSGGGGSGGGGGSGGGGSETVMTQSPTSMSTSIGERVTLNCKASQSVGINVDWYQQTPGQSPKLLIYGASNRHTGVPDRFTGSGFGRDFTLTISNVEAEDLAVYYCLQYGSIPFTFGSGTKLELK

SEQ ID NO: 1031 - protein, 10 aa, artificial
  VH CDR1 of BCMA-102
GYTFTNHIIH

SEQ ID NO: 1032 - protein, 17 aa, artificial
  VH CDR2 of BCMA-102
YINPYNDDTEYNEKFKG

SEQ ID NO: 1033 - protein, 12 aa, artificial
  VH CDR3 of BCMA-102
DGYYRDMDVMDY

SEQ ID NO: 1034 - protein, 11 aa, artificial
  VL CDR1 of BCMA-102
RASQDISNYLN

SEQ ID NO: 1035 - protein, 7 aa, artificial
  VL CDR2 of BCMA-102
YTSRLHS

SEQ ID NO: 1036 - protein, 9 aa, artificial
  VL CDR3 of BCMA-102
QQGNTLPWT

SEQ ID NO: 1037 - protein, 122 aa, artificial
  VH of BCMA-102
EVQLVEQSGPELVKPGASVKMSCKASGYTFTNHIIHWVKQKPGQGLEWIGYINPYNDDTEYNEKFKGKATLTSDKSSTTAYMELSSLTSEDSAVYYCARDGYYRDMDVMDYWGQGTTVTVSS

SEQ ID NO: 1038 - protein, 107 aa, artificial
  VL of BCMA-102
ELVMTQTPSSLSASLGDRVTISCRASQDISNYLNWYQQKPDGTVKLLIYYTSRLHSGVPSRFSGSGSGTDYSLTISNLEQEDIATYFCQQGNTLPWTFGGGTKLEIK

SEQ ID NO: 1039 - protein, 244 aa, artificial
  BCMA-102 scFv
EVQLVEQSGPELVKPGASVKMSCKASGYTFTNHIIHWVKQKPGQGLEWIGYINPYNDDTEYNEKFKGKATLTSDKSSTTAYMELSSLTSEDSAVYYCARDGYYRDMDVMDYWGQGTTVTVSSGGGGSGGGGSGGGGSELVMTQTPSSLSASLGDRVTISCRASQDISNYLNWYQQKPDGTVKLLIYYTSRLHSGVPSRFSGSGSGTDYSLTISNLEQEDIATYFCQQGNTLPWTFGGGTKLEIK

SEQ ID NO: 1040 - protein, 10 aa, artificial
  VH CDR1 of BCMA-103
GFTFSNYDMA

SEQ ID NO: 1041 - protein, 17 aa, artificial
  VH CDR2 of BCMA-103
SISTRGDITSYRDSVKG

SEQ ID NO: 1042 - protein, 12 aa, artificial
  VH CDR3 of BCMA-103
QDYYTDYMGFAY

SEQ ID NO: 1043 - protein, 11 aa, artificial
  VL CDR1 of BCMA-103
RASEDIYNGLA

SEQ ID NO: 1044 - protein, 7 aa, artificial
  VL CDR2 of BCMA-103
GASSLQD

SEQ ID NO: 1045 - protein, 9 aa, artificial
  VL CDR3 of BCMA-103
QQSYKYPLT

SEQ ID NO: 1046 - protein, 122 aa, artificial
  VH of BCMA-103
EVQLVEESGGGLLQPGRSLKLSCAASGFTFSNYDMAWVRQAPTKGLEWVASISTRGDITSYRDSVKGRFTISRDNAKSTLYLQMDSLRSEDTATYYCARQDYYTDYMGFAYWGQGTLVTVSS

SEQ ID NO: 1047 - protein, 107 aa, artificial
  VL of BCMA-103
ELVMTQSPASLSASLGETVTIECRASEDIYNGLAWYQQKPGKSPQLLIYGASSLQDGVPSRFSGSGSGTQYSLKISGMQPEDEANYFCQQSYKYPLTFGSGTKLELK

SEQ ID NO: 1048 - protein, 244 aa, artificial
  BCMA-103 scFv
EVQLVEESGGGLLQPGRSLKLSCAASGFTFSNYDMAWVRQAPTKGLEWVASISTRGDITSYRDSVKGRFTISRDNAKSTLYLQMDSLRSEDTATYYCARQDYYTDYMGFAYWGQGTLVTVSSGGGGSGGGGSGGGELVMTQSPASLSASLGETVTIECRASEDIYNGLAWYQQKPGKSPQLLIYGASSLQDGVPSRFSGSGSGTQYSLKISGMQPEDEANYFCQQSYKYPLTFGSGTKLELKGS

SEQ ID NO: 1049 - protein, 10 aa, artificial
  VH CDR1 of BCMA-104
GFTFSNFDMA

SEQ ID NO: 1050 - protein, 17 aa, artificial
  VH CDR2 of BCMA-104
SITTGGGDTYYRDSVKG

SEQ ID NO: 1051 - protein, 12 aa, artificial
  VH CDR3 of BCMA-104
HGYYDGYHLFDY

SEQ ID NO: 1052 - protein, 10 aa, artificial
  VL CDR1 of BCMA-104
RASQGISNYL

SEQ ID NO: 1053 - protein, 7 aa, artificial
  VL CDR2 of BCMA-104
YTSNLQS

SEQ ID NO: 1054 - protein, 9 aa, artificial
  VL CDR3 of BCMA-104
QQYDISSYT

SEQ ID NO: 1055 - protein, 122 aa, artificial
  VH of BCMA-104
EVQLVEESGGGLVQPGRSLKLSCAASGFTFSNFDMAWVRQAPTRGLEWVASITTGGGDTYYRDSVKGRFTISRDNAKSTLYLQMDSLRSEDTATYYCVRHGYYDGYHLFDYWGQGASVTVSS

SEQ ID NO: 1056 - protein, 107 aa, artificial
  VL of BCMA-104
ELVMTQTPSSMPASLGERVTISCRASQGISNYLNWYQQKPDGTIKPLIYYTSNLQSGVPSRFSGSGSGTDYSLTINSLEPEDFAVYYCQQYDISSYTFGAGTKLEIK

SEQ ID NO: 1057 - protein, 244 aa, artificial
  BCMA-104 scFv
EVQLVEESGGGLVQPGRSLKLSCAASGFTFSNFDMAWVRQAPTRGLEWVASITTGGGDTYYRDSVKGRFTISRDNAKSTLYLQMDSLRSEDTATYYCVRHGYYDGYHLFDYWGQGASVTVSSGGGGSGGGGSGGGGSELVMTQTPSSMPASLGERVTISCRASQGISNYLNWYQQKPDGTIKPLIYYTSNLQSGVPSRFSGSGSGTDYSLTINSLEPEDFAVYYCQQYDISSYTFGAGTKLEIK

SEQ ID NO: 1058 - protein, 10 aa, artificial
  VH CDR1 of BCMA-105
GFTFSNFDMA

SEQ ID NO: 1059 - protein, 17 aa, artificial
  VH CDR2 of BCMA-105
SITTGGGDTYYRDSVKG

SEQ ID NO: 1060 - protein, 12 aa, artificial
  VH CDR3 of BCMA-105
HGYYDGYHLFDY

SEQ ID NO: 1061 - protein, 11 aa, artificial
  VL CDR1 of BCMA-105
RASQGISNHLN

SEQ ID NO: 1062 - protein, 7 aa, artificial
  VL CDR2 of BCMA-105
YTSNLQS

SEQ ID NO: 1063 - protein, 9 aa, artificial
  VL CDR3 of BCMA-105
QQYDSFPLT

SEQ ID NO: 1064 - protein, 122 aa, artificial
  VH of BCMA-105
EVQLVEESGGGLVQPGRSLKLSCAASGFTFSNFDMAWVRQAPTRGLEWVASITTGGGDTYYRDSVKGRFTISRDNAKSTLYLQMDSLRSEDTATYYCVRHGYYDGYHLFDYWGQGTLVTVSS

SEQ ID NO: 1065 - protein, 107 aa, artificial
  VL of BCMA-105
ELVMTQTPSSMPASLGERVTISCRASQGISNHLNWYQQKPDGTIKPLIYYTSNLQSGVPSRFSGSGSGTDYSLTISSLEPEDFAMYYCQQYDSFPLTFGSGTKLEIK

SEQ ID NO: 1066 - protein, 244 aa, artificial
  BCMA-105 scFv
EVQLVEESGGGLVQPGRSLKLSCAASGFTFSNFDMAWVRQAPTRGLEWVASITTGGGDTYYRDSVKGRFTISRDNAKSTLYLQMDSLRSEDTATYYCVRHGYYDGYHLFDYWGQGTLVTVSSGGGGSGGGGSGGGGSELVMTQTPSSMPASLGERVTISCRASQGISNHLNWYQQKPDGTIKPLIYYTSNLQSGVPSRFSGSGSGTDYSLTISSLEPEDFAMYYCQQYDSFPLTFGSGTKLEIK

SEQ ID NO: 1067 - protein, 10 aa, artificial
  VH CDR1 of BCMA-106
GFTFSNFDMA

SEQ ID NO: 1068 - protein, 17 aa, artificial
  VH CDR2 of BCMA-106
SITTGGGDTYYRDSVKG

SEQ ID NO: 1069 - protein, 12 aa, artificial
  VH CDR3 of BCMA-106
HGYYDGYHLFDY

SEQ ID NO: 1070 - protein, 11 aa, artificial
  VL CDR1 of BCMA-106
RASQGISNNLN

SEQ ID NO: 1071 - protein, 7 aa, artificial
  VL CDR2 of BCMA-106
YTSNLQS

SEQ ID NO: 1072 - protein, 9 aa, artificial
  VL CDR3 of BCMA-106
QQFDTSPYT

SEQ ID NO: 1073 - protein, 122 aa, artificial
  VH of BCMA-106
EVQLVEESGGGLVQPGRSLKLSCAASGFTFSNFDMAWVRQAPTRGLEWVASITTGGGDTYYRDSVKGRFTISRDNAKSTLYLQMDSLRSEDTATYYCVRHGYYDGYHLFDYWGQGVMVTVSS

SEQ ID NO: 1074 - protein, 107 aa, artificial
  VL of BCMA-106
ELVMTQTPSSMPASLGERVTISCRASQGISNNLNWYQQKPDGTIKPLIYYTSNLQSGVPSRFSGSGSGTDYSLTISSLEPEDFAMYYCQQFDTSPYTFGAGTKLEIK

SEQ ID NO: 1075 - protein, 244 aa, artificial
  BCMA-106 scFv
EVQLVEESGGGLVQPGRSLKLSCAASGFTFSNFDMAWVRQAPTRGLEWVASITTGGGDTYYRDSVKGRFTISRDNAKSTLYLQMDSLRSEDTATYYCVRHGYYDGYHLFDYWGQGVMVTVSSGGGGSGGGGSGGGGSELVMTQTPSSMPASLGERVTISCRASQGISNNLNWYQQKPDGTIKPLIYYTSNLQSGVPSRFSGSGSGTDYSLTISSLEPEDFAMYYCQQFDTSPYTFGAGTKLEIK

SEQ ID NO: 1076 - protein, 10 aa, artificial
  VH CDR1 of BCMA-107
GYSFPDYYIN

SEQ ID NO: 1077 - protein, 13 aa, artificial
  VH CDR2 of BCMA-107
WIYFASGNSEYNE

SEQ ID NO: 1078 - protein, 10 aa, artificial
  VH CDR3 of BCMA-107
LYDYDWYFDV

SEQ ID NO: 1079 - protein, 16 aa, artificial
  VL CDR1 of BCMA-107
RSSQSLVHSNGNTYLH

SEQ ID NO: 1080 - protein, 7 aa, artificial
  VL CDR2 of BCMA-107
KVSNRFS

SEQ ID NO: 1081 - protein, 9 aa, artificial
  VL CDR3 of BCMA-107
SQSTHVPYT

SEQ ID NO: 1082 - protein, 120 aa, artificial
  VH of BCMA-107
EVQLVEQSGPELVKPGASVKISCKVSGYSFPDYYINWVKQRPGQGLEWIGWIYFASGNSEYNERFTGKATLTVDTSSNTAYMQLSSLTSEDTAVYFCASLYDYDWYFDVWGQGTTVTVSS

SEQ ID NO: 1083 - protein, 112 aa, artificial
  VL of BCMA-107
ELVMTQTPLSLPVSLGDQASISCRSSQSLVHSNGNTYLHWYLQKPGQSPKLLIYKVSNRFSGVPDRFSGSGSGADFTLKISRVEAEDLGVYFCSQSTHVPYTFGGGTKLEIK

SEQ ID NO: 1084 - protein, 247 aa, artificial
  BCMA-107 scFv
EVQLVEQSGPELVKPGASVKISCKVSGYSFPDYYINWVKQRPGQGLEWIGWIYFASGNSEYNERFTGKATLTVDTSSNTAYMQLSSLTSEDTAVYFCASLYDYDWYFDVWGQGTTVTVSSGGGGSGGGGSGGGGSELVMTQTPLSLPVSLGDQASISCRSSQSLVHSNGNTYLHWYLQKPGQSPKLLIYKVSNRFSGVPDRFSGSGSGADFTLKISRVEAEDLGVYFCSQSTHVPYTFGGGTKLEIK

SEQ ID NO: 1085 - protein, 10 aa, artificial
  VH CDR1 of BCMA-108
GYSFPDYYIN

SEQ ID NO: 1086 - protein, 13 aa, artificial
  VH CDR2 of BCMA-108
WIYFASGNSEYNE

SEQ ID NO: 1087 - protein, 10 aa, artificial
  VH CDR3 of BCMA-108
LYDYDWYFDV

SEQ ID NO: 1088 - protein, 16 aa, artificial
  VL CDR1 of BCMA-108
RSSQSLVHSNGNTYLH

SEQ ID NO: 1089 - protein, 7 aa, artificial
  VL CDR2 of BCMA-108
KVSNRFS

SEQ ID NO: 1090 - protein, 9 aa, artificial
  VL CDR3 of BCMA-108
FQGSHVPWT

SEQ ID NO: 1091 - protein, 120 aa, artificial
  VH of BCMA-108
EVQLVEQSGPQLVKPGASVKISCKVSGYSFPDYYINWVKQRPGQGLEWIGWIYFASGNSEYNERFTGKATLTVDTSSNTAYMQLSSLTSEDTAVYFCASLYDYDWYFDVWGQGTTVTVSS

SEQ ID NO: 1092 - protein, 112 aa, artificial
  VL of BCMA-108
ELVMTQTPLSLPVSLGDQASISCRSSQSLVHSNGNTYLHWYLQKPGQSPKLLIYKVSNRFSGVPGRFSGSGSGTDFTLKINRVEAEDLGVYYCFQGSHVPWTFGGGTKLEIK

SEQ ID NO: 1093 - protein, 247 aa, artificial
  BCMA-108 scFv
EVQLVEQSGPQLVKPGASVKISCKVSGYSFPDYYINWVKQRPGQGLEWIGWIYFASGNSEYNERFTGKATLTVDTSSNTAYMQLSSLTSEDTAVYFCASLYDYDWYFDVWGQGTTVTVSSGGGGSGGGGSGGGGSELVMTQTPLSLPVSLGDQASISCRSSQSLVHSNGNTYLHWYLQKPGQSPKLLIYKVSNRFSGVPGRFSGSGSGTDFTLKINRVEAEDLGVYYCFQGSHVPWTFGGGTKLEIK

SEQ ID NO: 1094 - protein, 12 aa, artificial
  histidine tag
SGHHGGHHGGHH

What is claimed is:

1. A bispecific binding molecule comprising
(I) a first binding domain capable of binding to epitope cluster 3 and to epitope cluster 4 of B cell maturation antigen (BCMA), the first binding domain comprising a VH region comprising CDR-H1, CDR-H2 and CDR-H3 and a VL region comprising CDR-L1, CDR-L2 and CDR-L3 selected from the group consisting of:
   (a) CDR-H1 as depicted in SEQ ID NO: 231, CDR-H2 as depicted in SEQ ID NO: 232, CDR-H3 as depicted in SEQ ID NO: 233, CDR-L1 as depicted in SEQ ID NO: 234, CDR-L2 as depicted in SEQ ID NO: 235 and CDR-L3 as depicted in SEQ ID NO: 236;
   (b) CDR-H1 as depicted in SEQ ID NO: 241, CDR-H2 as depicted in SEQ ID NO: 242, CDR-H3 as depicted in SEQ ID NO: 243, CDR-L1 as depicted in SEQ ID NO: 244, CDR-L2 as depicted in SEQ ID NO: 245 and CDR-L3 as depicted in SEQ ID NO: 246;
   (c) CDR-H1 as depicted in SEQ ID NO: 251, CDR-H2 as depicted in SEQ ID NO: 252, CDR-H3 as depicted in SEQ ID NO: 253, CDR-L1 as depicted in SEQ ID NO: 254, CDR-L2 as depicted in SEQ ID NO: 255 and CDR-L3 as depicted in SEQ ID NO: 256;
   (d) CDR-H1 as depicted in SEQ ID NO: 261, CDR-H2 as depicted in SEQ ID NO: 262, CDR-H3 as depicted in SEQ ID NO: 263, CDR-L1 as depicted in SEQ ID NO: 264, CDR-L2 as depicted in SEQ ID NO: 265 and CDR-L3 as depicted in SEQ ID NO: 266;
   (e) CDR-H1 as depicted in SEQ ID NO: 271, CDR-H2 as depicted in SEQ ID NO: 272, CDR-H3 as depicted in SEQ ID NO: 273, CDR-L1 as depicted in SEQ ID NO: 274, CDR-L2 as depicted in SEQ ID NO: 275 and CDR-L3 as depicted in SEQ ID NO: 276;
   (f) CDR-H1 as depicted in SEQ ID NO: 281, CDR-H2 as depicted in SEQ ID NO: 282, CDR-H3 as depicted in SEQ ID NO: 283, CDR-L1 as depicted in SEQ ID NO: 284, CDR-L2 as depicted in SEQ ID NO: 285 and CDR-L3 as depicted in SEQ ID NO: 286;
   (g) CDR-H1 as depicted in SEQ ID NO: 291, CDR-H2 as depicted in SEQ ID NO: 292, CDR-H3 as depicted in SEQ ID NO: 293, CDR-L1 as depicted in SEQ ID NO: 294, CDR-L2 as depicted in SEQ ID NO: 295 and CDR-L3 as depicted in SEQ ID NO: 296;
   (h) CDR-H1 as depicted in SEQ ID NO: 301, CDR-H2 as depicted in SEQ ID NO: 302, CDR-H3 as depicted in SEQ ID NO: 303, CDR-L1 as depicted in SEQ ID NO: 304, CDR-L2 as depicted in SEQ ID NO: 305 and CDR-L3 as depicted in SEQ ID NO: 306;
   (i) CDR-H1 as depicted in SEQ ID NO: 391, CDR-H2 as depicted in SEQ ID NO: 392, CDR-H3 as depicted in SEQ ID NO: 393, CDR-L1 as depicted in SEQ ID NO: 394, CDR-L2 as depicted in SEQ ID NO: 395 and CDR-L3 as depicted in SEQ ID NO: 396;
   (k) CDR-H1 as depicted in SEQ ID NO: 401, CDR-H2 as depicted in SEQ ID NO: 402, CDR-H3 as depicted in SEQ ID NO: 403, CDR-L1 as depicted in SEQ ID NO: 404, CDR-L2 as depicted in SEQ ID NO: 405 and CDR-L3 as depicted in SEQ ID NO: 406;
   (l) CDR-H1 as depicted in SEQ ID NO: 411, CDR-H2 as depicted in SEQ ID NO: 412, CDR-H3 as depicted in SEQ ID NO: 413, CDR-L1 as depicted in SEQ ID NO: 414, CDR-L2 as depicted in SEQ ID NO: 415 and CDR-L3 as depicted in SEQ ID NO: 416;
   (m) CDR-H1 as depicted in SEQ ID NO: 421, CDR-H2 as depicted in SEQ ID NO: 422, CDR-H3 as depicted in SEQ ID NO: 423, CDR-L1 as depicted in SEQ ID NO: 424, CDR-L2 as depicted in SEQ ID NO: 425 and CDR-L3 as depicted in SEQ ID NO: 426;
   (n) CDR-H1 as depicted in SEQ ID NO: 431, CDR-H2 as depicted in SEQ ID NO: 432, CDR-H3 as depicted in SEQ ID NO: 433, CDR-L1 as depicted in SEQ ID NO: 434, CDR-L2 as depicted in SEQ ID NO: 435 and CDR-L3 as depicted in SEQ ID NO: 436;
   (o) CDR-H1 as depicted in SEQ ID NO: 441, CDR-H2 as depicted in SEQ ID NO: 442, CDR-H3 as depicted in SEQ ID NO: 443, CDR-L1 as depicted in SEQ ID NO: 444, CDR-L2 as depicted in SEQ ID NO:445 and CDR-L3 as depicted in SEQ ID NO: 446;
   (p) CDR-H1 as depicted in SEQ ID NO: 451, CDR-H2 as depicted in SEQ ID NO: 452, CDR-H3 as depicted in SEQ ID NO: 453, CDR-L1 as depicted in SEQ ID NO: 454, CDR-L2 as depicted in SEQ ID NO: 455 and CDR-L3 as depicted in SEQ ID NO: 456;
   (q) CDR-H1 as depicted in SEQ ID NO: 461, CDR-H2 as depicted in SEQ ID NO: 462, CDR-H3 as depicted in SEQ ID NO: 463, CDR-L1 as depicted in SEQ ID NO: 464, CDR-L2 as depicted in SEQ ID NO: 465 and CDR-L3 as depicted in SEQ ID NO: 466;
   (r) CDR-H1 as depicted in SEQ ID NO: 471, CDR-H2 as depicted in SEQ ID NO: 472, CDR-H3 as depicted in SEQ ID NO: 473, CDR-L1 as depicted in SEQ ID NO: 474, CDR-L2 as depicted in SEQ ID NO: 475 and CDR-L3 as depicted in SEQ ID NO: 476;
   (s) CDR-H1 as depicted in SEQ ID NO: 481, CDR-H2 as depicted in SEQ ID NO: 482, CDR-H3 as depicted in SEQ ID NO: 483, CDR-L1 as depicted in SEQ ID NO: 484, CDR-L2 as depicted in SEQ ID NO: 485 and CDR-L3 as depicted in SEQ ID NO: 486;
   (t) CDR-H1 as depicted in SEQ ID NO: 491, CDR-H2 as depicted in SEQ ID NO: 492, CDR-H3 as depicted in SEQ ID NO: 493, CDR-L1 as depicted in SEQ ID NO: 494, CDR-L2 as depicted in SEQ ID NO: 495 and CDR-L3 as depicted in SEQ ID NO: 496; and
   (u) CDR-H1 as depicted in SEQ ID NO: 501, CDR-H2 as depicted in SEQ ID NO: 502, CDR-H3 as depicted in SEQ ID NO: 503, CDR-L1 as depicted in SEQ ID NO: 504, CDR-L2 as depicted in SEQ ID NO: 505 and CDR-L3 as depicted in SEQ ID NO: 506; and
(II) a second binding domain capable of binding to a T cell CD3 receptor complex; and wherein the epitope cluster 3 of BCMA corresponds to amino acid residues 24 to 41 of the sequence as depicted in SEQ ID NO: 1002, and the epitope cluster 4 of BCMA corresponds to amino acid residues 42 to 54 of the sequence as depicted in SEQ ID NO: 1002.

2. The binding molecule of claim 1, wherein the first binding domain is not capable of binding to the chimeric extracellular domain of BCMA as depicted in SEQ ID NO: 1015.

3. The binding molecule according to claim 1, wherein the first binding domain is further capable of binding to macaque BCMA.

4. The binding molecule according to claim 1, wherein the T cell CD3 receptor complex comprises CD3 epsilon and the second binding domain is capable of binding to CD3 epsilon.

5. The binding molecule according to claim 1, wherein the T cell CD3 receptor complex comprises human or macaque CD3 and the second binding domain is capable of binding to human CD3 and to macaque CD3.

6. The binding molecule according to claim 1, wherein the first and/or the second binding domain are from an antibody.

7. The binding molecule according to claim 6, which is selected from the group consisting of (scFv)$_2$, (single domain mAb)$_2$, scFv-single domain mAb, diabodies and oligomers thereof.

8. The binding molecule according to claim 1, wherein the first binding domain comprises a VH region and a VL region comprising
CDR-H1 as depicted in SEQ ID NO: 231, CDR-H2 as depicted in SEQ ID NO: 232, CDR-H3 as depicted in SEQ ID NO: 233, CDR-L1 as depicted in SEQ ID NO: 234, CDR-L2 as depicted in SEQ ID NO: 235 and CDR-L3 as depicted in SEQ ID NO: 236.

9. The binding molecule according to claim 1, wherein the first binding domain comprises a VH region selected from the group consisting of VH regions as depicted in SEQ ID NO: 237, SEQ ID NO: 247, SEQ ID NO: 257, SEQ ID NO: 267, SEQ ID NO: 277, SEQ ID NO: 287, SEQ ID NO: 297, SEQ ID NO: 307, SEQ ID NO: 397, SEQ ID NO: 407, SEQ ID NO: 417, SEQ ID NO: 427, SEQ ID NO: 437, SEQ ID NO: 447, SEQ ID NO: 457, SEQ ID NO: 467, SEQ ID NO: 477, SEQ ID NO: 487, SEQ ID NO: 497, and SEQ ID NO: 507.

10. The binding molecule according to claim 1, wherein the first binding domain comprises a VL region selected from the group consisting of VL regions as depicted in SEQ ID NO: 238, SEQ ID NO: 248, SEQ ID NO: 258, SEQ ID NO: 268, SEQ ID NO: 278, SEQ ID NO: 288, SEQ ID NO: 298, SEQ ID NO: 308, SEQ ID NO: 398, SEQ ID NO: 408, SEQ ID NO: 418, SEQ ID NO: 428, SEQ ID NO: 438, SEQ ID NO: 448, SEQ ID NO: 458, SEQ ID NO: 468, SEQ ID NO: 478, SEQ ID NO: 488, SEQ ID NO: 498, and SEQ ID NO: 508.

11. The binding molecule according to claim 1, wherein the first binding domain comprises a VH region and a VL region selected from the group consisting of:
(a) a VH region as depicted in SEQ ID NO: 237, and a VL region as depicted in SEQ ID NO: 238;
(b) a VH region as depicted in SEQ ID NO: 247, and a VL region as depicted in SEQ ID NO: 248;
(c) a VH region as depicted in SEQ ID NO: 257, and a VL region as depicted in SEQ ID NO: 258;
(d) a VH region as depicted in SEQ ID NO: 267, and a VL region as depicted in SEQ ID NO: 268;
(e) a VH region as depicted in SEQ ID NO: 277, and a VL region as depicted in SEQ ID NO: 278;
(f) a VH region as depicted in SEQ ID NO: 287, and a VL region as depicted in SEQ ID NO: 288;
(g) a VH region as depicted in SEQ ID NO: 297, and a VL region as depicted in SEQ ID NO: 298;
(h) a VH region as depicted in SEQ ID NO: 307, and a VL region as depicted in SEQ ID NO: 308;
(i) a VH region as depicted in SEQ ID NO: 397, and a VL region as depicted in SEQ ID NO: 398;
(k) a VH region as depicted in SEQ ID NO: 407, and a VL region as depicted in SEQ ID NO: 408;
(l) a VH region as depicted in SEQ ID NO: 417, and a VL region as depicted in SEQ ID NO: 418;
(m) a VH region as depicted in SEQ ID NO: 427, and a VL region as depicted in SEQ ID NO: 428;
(n) a VH region as depicted in SEQ ID NO: 437, and a VL region as depicted in SEQ ID NO: 438;
(o) a VH region as depicted in SEQ ID NO: 447, and a VL region as depicted in SEQ ID NO: 448;
(p) a VH region as depicted in SEQ ID NO: 457, and a VL region as depicted in SEQ ID NO: 458;
(q) a VH region as depicted in SEQ ID NO: 467, and a VL region as depicted in SEQ ID NO: 468;
(r) a VH region as depicted in SEQ ID NO: 477, and a VL region as depicted in SEQ ID NO: 478;
(s) a VH region as depicted in SEQ ID NO: 487, and a VL region as depicted in SEQ ID NO: 488;
(t) a VH region as depicted in SEQ ID NO: 497, and a VL region as depicted in SEQ ID NO: 498; and
(u) a VH region as depicted in SEQ ID NO: 507, and a VL region as depicted in SEQ ID NO: 508.

12. The binding molecule according to claim 10, wherein the first binding domain comprises an amino acid sequence selected from the group consisting of SEQ ID NO: 239, SEQ ID NO: 249, SEQ ID NO: 259, SEQ ID NO: 269, SEQ ID NO: 279, SEQ ID NO: 289, SEQ ID NO: 299, SEQ ID NO: 309, SEQ ID NO: 399, SEQ ID NO: 409, SEQ ID NO: 419, SEQ ID NO: 429, SEQ ID NO: 439, SEQ ID NO: 449, SEQ ID NO: 459, SEQ ID NO: 469, SEQ ID NO: 479, SEQ ID NO: 489, SEQ ID NO: 499, and SEQ ID NO: 509.

13. The binding molecule according to claim 1 having the amino acid sequence shown in SEQ ID NO:300 or SEQ ID NO: 500.

14. A composition comprising any one of the binding molecule according to claim 1 and a pharmaceutically acceptable carrier.

15. A kit comprising any one of the binding molecule as defined in claim 1.

* * * * *